US011618784B2

(12) United States Patent
Pogue et al.

(10) Patent No.: US 11,618,784 B2
(45) Date of Patent: Apr. 4, 2023

(54) ANTI-CD47 COMBINATION THERAPY

(71) Applicant: TEVA PHARMACEUTICALS AUSTRALIA PTY LTD, New South Wales (AU)

(72) Inventors: Sarah Lee Pogue, Redwood City, CA (US); David Scofield Wilson, Redwood City, CA (US); Tetsuya Taura, Redwood City, CA (US)

(73) Assignee: Teva Pharmaceuticals Australia Pty Ltd., Macquarie Park (AU)

( * ) Notice: Subject to any disclaimer, the term of this patent is extended or adjusted under 35 U.S.C. 154(b) by 0 days.

(21) Appl. No.: 16/317,077

(22) PCT Filed: Jul. 19, 2017

(86) PCT No.: PCT/AU2017/000150
§ 371 (c)(1),
(2) Date: Jan. 11, 2019

(87) PCT Pub. No.: WO2018/014067
PCT Pub. Date: Jan. 25, 2018

(65) Prior Publication Data
US 2020/0010544 A1    Jan. 9, 2020

Related U.S. Application Data

(60) Provisional application No. 62/363,982, filed on Jul. 19, 2016.

(51) Int. Cl.
*A61K 38/21*    (2006.01)
*C07K 16/28*    (2006.01)
*A61P 35/00*    (2006.01)

(52) U.S. Cl.
CPC ........ *C07K 16/2803* (2013.01); *A61K 38/212* (2013.01); *A61P 35/00* (2018.01); *C07K 16/2896* (2013.01)

(58) Field of Classification Search
CPC .................................................. A61K 38/212
See application file for complete search history.

(56) References Cited

U.S. PATENT DOCUMENTS

| | | |
|---|---|---|
| 5,225,539 A | 7/1993 | Winter |
| 5,558,864 A | 9/1996 | Bendig et al. |
| 5,565,332 A | 10/1996 | Hoogenboom et al. |
| 5,585,089 A | 12/1996 | Queen et al. |
| 5,677,171 A | 10/1997 | Hudziak et al. |
| 5,693,761 A | 12/1997 | Queen et al. |
| 5,770,195 A | 6/1998 | Hudziak et al. |
| 5,772,997 A | 6/1998 | Hudziak et al. |
| 5,837,821 A | 11/1998 | Wu |
| 5,844,093 A | 12/1998 | Kettleborough et al. |
| 5,976,531 A | 11/1999 | Mezes et al. |
| 5,977,322 A | 11/1999 | Marks et al. |
| 6,054,297 A | 4/2000 | Carter et al. |
| 6,180,370 B1 | 1/2001 | Queen et al. |
| 6,248,516 B1 | 6/2001 | Winter et al. |
| 6,277,375 B1 | 8/2001 | Ward |
| 6,300,064 B1 | 10/2001 | Knappik et al. |
| 6,417,337 B1 | 7/2002 | Anderson et al. |
| 6,512,097 B1 | 1/2003 | Marks et al. |
| 6,602,684 B1 | 8/2003 | Umana et al. |
| 6,821,505 B2 | 11/2004 | Ward |
| 6,903,203 B2 | 6/2005 | Copley et al. |
| 7,083,784 B2 | 8/2006 | Dall et al. |
| 7,202,346 B2 | 4/2007 | Payne et al. |
| 7,217,797 B2 | 5/2007 | Hinton et al. |
| 7,282,556 B2 | 10/2007 | Parkos |
| 7,326,681 B2 | 2/2008 | Gerngross |
| 7,388,081 B2 | 6/2008 | Seki et al. |
| 7,456,257 B2 | 11/2008 | Jones et al. |
| 7,566,771 B1 | 7/2009 | Adair et al. |
| 7,723,485 B2 | 5/2010 | Junutula et al. |
| 7,732,578 B2 | 6/2010 | Foote |
| 7,776,330 B2 | 8/2010 | Yazaki et al. |
| 7,829,672 B2 | 11/2010 | Dib-Hajj et al. |
| 8,039,593 B2 | 10/2011 | Kuan et al. |
| 8,101,719 B2 | 1/2012 | Kikuchi et al. |
| 8,124,738 B2 | 2/2012 | Terret et al. |
| 8,562,997 B2 | 10/2013 | Jaiswal et al. |
| 8,563,692 B2 | 10/2013 | Morrison et al. |
| 8,758,750 B2 | 6/2014 | Weissman et al. |
| 9,017,675 B2 | 4/2015 | Liu et al. |
| 9,045,541 B2 | 6/2015 | Eckelman et al. |
| 9,221,908 B2 | 12/2015 | Frazier et al. |

(Continued)

FOREIGN PATENT DOCUMENTS

EP    0706799 A2    4/1996
JP    2015-528698 A    10/2015

(Continued)

OTHER PUBLICATIONS

Rossi et al., Blood, 2009, vol. 114, No. 18, 3864-3871.
Saleh et al., J. Immunol., 1993, 151, 3390-3398.
Schier et al., J. Mol. Biol., 1996, 255, 28-43.
Schier et al., J. Mol. Biol., 1996, 263, 551-567.
Sgouros et al., J. Nucl. Med., 1993, 34, 422-430.
Shields, Namenuk et al., J. Biol. Chem., 2001, 276, 6591-6592.
Shinkawa et al., J. Biol. Chem., 2003, 278, 3466-3473.
Shitara et al., Cancer Immunol. Immunother. 1993, 36, 373-380.
Sick et al, Brit. J. of Pharmacology, 2012, 167, 1415-1430.
Sievers et al., Blood, 1999, 93, 3678-3684.

(Continued)

*Primary Examiner* — Prema M Mertz
(74) *Attorney, Agent, or Firm* — BakerHostetler

(57) ABSTRACT

The present invention provides a combination therapy for treating a tumor in a subject. The combination comprises two elements. The first is a polypeptide construct comprising an attenuated Type 1 interferon (IFN) linked to an antibody which binds to a cell surface-associated antigen expressed on the tumour cell and comprising a functional Fc region. The second is a CD47 antagonist which inhibits the interaction CD47 with the SIRPα receptor.

21 Claims, 15 Drawing Sheets
Specification includes a Sequence Listing.

(56) References Cited

U.S. PATENT DOCUMENTS

| | | |
|---|---|---|
| 2002/0142358 A1 | 10/2002 | Mikayama et al. |
| 2002/0164788 A1 | 11/2002 | Ellis et al. |
| 2003/0211100 A1 | 11/2003 | Bedian et al. |
| 2004/0006215 A1 | 1/2004 | Keler et al. |
| 2004/0071696 A1 | 4/2004 | Adams et al. |
| 2006/0083736 A1 | 4/2006 | Law et al. |
| 2006/0099205 A1 | 5/2006 | Adams et al. |
| 2008/0181829 A1 | 7/2008 | Matteo |
| 2008/0181892 A1 | 7/2008 | Ledbetter et al. |
| 2008/0227958 A1 | 9/2008 | Thompson et al. |
| 2009/0068175 A1 | 3/2009 | Lazar et al. |
| 2009/0092599 A1 | 4/2009 | Lazar et al. |
| 2009/0123950 A1 | 5/2009 | Tesar |
| 2009/0142340 A1 | 6/2009 | Lazar et al. |
| 2009/0304710 A1 | 12/2009 | Park et al. |
| 2010/0297076 A1 | 11/2010 | Morrison et al. |
| 2012/0189625 A1 | 7/2012 | Wang et al. |
| 2012/0282174 A1 | 11/2012 | Weissman et al. |
| 2013/0224188 A1 | 8/2013 | Eckelman et al. |
| 2014/0140989 A1 | 5/2014 | Eckelman et al. |
| 2014/0161805 A1 | 6/2014 | Jamieson et al. |
| 2014/0199308 A1 | 7/2014 | Van Den Berg |
| 2015/0274826 A1 | 10/2015 | Frazier et al. |
| 2015/0329616 A1 | 11/2015 | Uger et al. |
| 2015/0353642 A1 | 12/2015 | Tykocinski |
| 2016/0008429 A1 | 1/2016 | Willingham et al. |
| 2016/0009814 A1 | 1/2016 | Jaiswal et al. |
| 2016/0009815 A1 | 1/2016 | Jaiswal et al. |

FOREIGN PATENT DOCUMENTS

| | | |
|---|---|---|
| WO | 90/05144 A1 | 5/1990 |
| WO | 97/00271 A1 | 1/1997 |
| WO | 00/42072 A2 | 7/2000 |
| WO | 01/97844 A1 | 12/2001 |
| WO | 2004/042072 A2 | 5/2004 |
| WO | 2008/006554 A2 | 1/2008 |
| WO | 2011/143624 A2 | 11/2011 |
| WO | 2012/092612 A1 | 7/2012 |
| WO | 2013/059885 A2 | 5/2013 |
| WO | 2014/009535 A3 | 4/2014 |
| WO | 2014/144357 A1 | 9/2014 |
| WO | 2014/178820 A1 | 11/2014 |
| WO | 2015/105995 A2 | 7/2015 |
| WO | 2015/138600 A2 | 9/2015 |
| WO | 2016/022971 A1 | 2/2016 |
| WO | 2016/065409 A1 | 5/2016 |
| WO | 2017/053423 A1 | 3/2017 |

OTHER PUBLICATIONS

Smith, M. J. Clin. Oncol., 1992, 10, 839-864.
Sockolosky et al, PNAS, 2016, 10.1073, E2646-E2654.
Stavenhagen, Gorlatov et al., Cancer Res., 2007, 67, 8882-8890.
Tailor et al., Nucl. Acids Res., 1990, 18(16), 4928.
Tan et al., PNAS, 1990, 87, 162-166.
Thie et al. Methods Mol Biol, 2009, 525, 309-322.
Trail et al., Cancer Research, 1997, 57, 100-105.
Trail et al., Science, 1993, 261, 212-215.
Trauth et al., Science, 1989, 245, 301-304.
Van Rooijen et al., J. Immunol. Meth. 1996, 193, 93-99.
VanHof et al., Cancer Res., 1996, 56, 5179-5185.
Vijayasardahi et al., J. Exp. Med., 1990, 171(4), 1375-1380.
Wahl et al., Cancer Research, 2002, 62(13), 3736-3742.
Ward et al., Nature, 1989, 341, 544-546.
Weiskopf, European Journal of Cancer, 2017, 76:100-109.
Xuan, et al., Targeted delivery of interferon-a via fusion to anti-CD20 results in potent antitumor activity against B-cell lymphoma. Blood 2010;115:2864-2871.
Yokata et al., Cancer Res., 1992, 52, 3402-3408.
Yu et al., Cancer Res., 1991, 51(2), 468-475.
Zeng et al., Oncotarget, 2016, vol. 7, 83040-83050.
Aass, N. et al. J. Clin. Oncol., 2005, 23, 4172-4178.
Alkan et al., Journal of Interferon Research, 1984, vol. 4, No. 3, p. 355-63.
Barnstable et al., Cell, 1978, 14, 9-20.
Behr et al., Clin. Cancer Res., 1999, 5, 3304s-3314s.
Benhar, Expert Opin Biol Ther., May 2007, 7(5), 763-779.
Bergsagel, P., Blood, 1995, 85,436-447.
Bhattacharya-Chatterjee et al., J. Immunol., 1988, 141, 1398-1403.
Bird et al., Science, 1988, 242, 423-426.
Bonardi et al., Cancer Res., 1993, 53, 3015-3021.
Borden, Cancer Research 42:4948-53, 1982.
Bowen et al., J. Immunol., 1993, 151, 5896-5906.
Braster, O'Toole et al., Methods, 2014, 65, 28-37.
Brekke, Bremnes et al., Mol. Immunol., 1993, 30, 1419-1425.
Bumol, Hybridoma, 1988, 7(4), 407-415.
Camploi et al., Crit. Rev. Immunol., 2004, 24, 267-296.
Caraglia, Cell Death and Differentiation, 1999, 6, 773-780.
Chawla-Sarkar, Clinical Cancer Research 7: 1821-31, 2001.
Col, J. et al. Cancer Res. 72:1825, 2012.
Dall'Acqua et al., J. Biol. Chem, 2006, 281, 23514-23524.
Dall'Acqua, Woods et al., J. Immunol, 2002, 169, 5171-5180.
Davies & Riechmann, FEBS Letters, 1994, 339, 285-290.
Deaglio, S., Trends in Mol. Med., 2008, 14(5), 210-218.
Divgi et al., Nucl. Med. Biol., 1994, 21, 9-15.
Durig, J., Leuk. Res., 2002, 25, 927-932.
Ellis et al., J. Immunol., 1995, 155, 925-937.
Estin et al., J. Natl. Cancer Instit., 1989, 81(6), 445-446.
Feizi., Nature, 1985, 314, 53-57.
Ferrara et al., Biotechnol. Bioeng. 2006, 93, 851-861.
Fishburn, J. Pharm. Sci., 2008, 97, 4167-4183.
Foon et al., Proc. Am. Soc. Clin. Oncol., 1994, 13, 294.
Francisco et al., Cancer Res., 2000, 60, 3225-3231.
Frankel et al., Cancer Biother. Radiopharm., 2000, 15, 459, 76.
Funaro., A., J. Immunol., 1990, 145, 2390-2396.
Ghetie et al., Blood, 1994, 83, 1329-1336.
Gul & Egmond, Cancer Research, 2015, 75, 5008-5013.
Hamers-Casterman et al., Nature, 1993, 363, 446-448.
Hatherley et al., 2007, J.B.C. 282:14567-75.
Hellstrom et al., Cancer Res., 1985, 45, 2210-2218.
Hellstrom et al., Cancer Res., 1986, 46, 3917-3923.
Henttu and Vihko, Biochem, Biophys, Res. Comm., 1989, 160(2), 903-910.
Herlyn et al., J. Clin. Immumol., 1982, 2, 135-140.
Herold, M. et al. Acta Dermatovener 74:29 1975.
Hilkens et al., Trends in Bio. Chem. Sci., 1992, 17, 359-363.
Hinton et al., J. Immunol, 2006, 176, 346-356.
Hinton, Johlfs et al., J. Biol. Chem. 2004, 279, 6213-6216.
Hollinger, et al., Proc. Natl. Acad. Sci. USA, 1993, 90, 6444-6448.
Hoon et al., Cancer Res., 1993, 53, 5244-5250.
Huston et al., Proc. Natl. Acad. Sci., USA, 1988, 85, 5879-5883.
Ibrahmin, S., Blood, 2001, 98, 181-186.
Israeli et al., Cancer Res., 1993, 53, 227-230.
Jones, Papac et al., Glycobiology, 2007, 17, 529-540.
Kanda, Yamada et al., Glycobiology, 2007, 17, 104-118.
Kaneko, Nimmerjahn et al., Science, 2006, 313, 670-673.
Kast, R. Cancer Biology and Therapy, 2008, 7, 1515-1519.
Keller et al., Int. J. Cancer; 1990, 46, 682-686.
Koguma, T., Biochem, Biophys, Acta, 1994, 1223, 160-162.
Kolkman and Stemmer, Nat. Biotechnol., May 2001, 19(5), 423-428.
Kopsidas, Roberts et al., Immunol. Lett., Nov. 15, 2006, 107(2), 163-168.
Kossman et al., Clin. Cancer Research, 1999, 5, 2748-2755.
Ku & Schutz, Proc. Natl. Acad. Sci. USA, 1995, 92, 6552-6556.
Lee et al., 2007, J. Immunol. 179:7741-7750.
Lee et al., 2010, J.B.C. 285: 37953-63.
Li et al., Cell. Immunol., 1989, 111, 85-99.
Li, Sethuraman et al., Nat. Biotechnol., 2006, 24, 210-215.
Lindner, Journal of Interferon and Cytokine Research, 1997, 17, 681-693.
Liu et al., 2015, PLOS ONE 10(9): eOI 37345, 23 pages.
Liu, Q., Structure, 2005, 13, 1331-1339.
Livingston et al., J. Clin. Oncol., 1994, 12, 1036-1044.

(56) References Cited

OTHER PUBLICATIONS

Ma, World J. Gastroenterol., 2005, 11(10), 1521-1528.
Maier et al., Cancer Res., 1991, 51, 5361-5369.
Malavasl, F., J. Clin. Lab Res., 1992, 22, 73-80.
Mason et al., Blood, 1987, 69, 836-840.
McCracken, M. et al. 2015 "Molecular Pathways: Activating T Cells after Cancer Cell Phagocytosis from Blockade of CD4 7 "Don't Eat Me" Signals", Clin. Cancer. Res. Vol. 21, No. 16, pp. 3597-3601.
Mehta (Mol Cancer Ther 3(3):345-52, 2004.
Meyskens, F. et al. Grit Rev Oncol Hematol., 1987, 3, 75-101.
Michaelsen, Aase et al., Scand. J. Immunol., 1990, 32, 517-528.
Mittelman et al., J. Clin. Invest. 1990, 86, 2136-2144.
Mogensen, Int. J. Cancer, 1981, 28, 575-582.
Morabito, F., Haematologica., 2002, 87, 217-218.
Motzer, R. J. Clin. Oncol., 2000, 18, 2972-2980.
Murray, Semin. Oncol., 2000, 27, 64-70.
Natali et al., Cancer, 1987, 59, 55-63.
Natsume et al., Cancer Research, 2008, 68, 3863-3872.
Norderhaug, Brekke et al., Eur. J. Immunol., 1991, 21, 2379-2384.
Ono et al.. Mol. Immuno., 1999, 36, 387-395.
Otsuka, British Journal of Haematology, 1998, 103, 518-529.
Ozzello et al., Breast Cancer Research and Treatment, 1993, 25: 265-76.
Pavlinkova et al., Clin. Cancer Res., 1999, 5, 2613-2619.
Peled, Kuang et al., Annu Rev Immunol., 2008, 26, 481-511.
Perez and Walker, J. Immunol., 1990, 142, 3662-3667.
Peterson et al., Cancer Res., 1997, 57, 1103-1108.
Petkova, Akilesh etaL, Int. Immunol., 2006, 18, 1759-1769.
Petrova et al., Clin Cancer Res, 2016, 1068-1079.
Poljaketal, Structure, 1994, 2, 1121-1123.
Queen, Schneider et al., PNAS, 1989, 86(24), 10029-10033.
Ragnhammar et al., Int. J. Cancer, 1993, 53, 751-758.
Recchia, F. et al. J. Interferon Cytokine Res. 15, 1995, 605-610.
Reff et al., Blood, 1994, 83,435-445.
Richards J., et al., Mol. Can. Ther., 2008, vol. 8, 2517-2527.
Rosenblum et al., Clin. Cancer Res., 1999, 5, 865-874.
"Is there a difference in antibody production between interferon-alpha subtypes?," Journal of Clinical Experimental Medicine, vol. 151, Issue 7, 1989, p. 397. (2 pages of English Translation and 1 page of Original document).
"Latest Pharmacotherapy manual-Dosing Basics and Treatment Program," Japanese Journal of Clinical Medicine (Speical Edition) Latest Pharmacotherapy Manual (1st), vol. 49, Issue 622, 1991, p. 227. (2 pages of English Translation and 1 page of Original document).
Chao M.P. et al., "The CD47-SIRPa pathway in cancer immune evasion and potential therapeutic implications," Current Opinion in Immunology, vol. 24, Issue 2, Apr. 2012, pp. 225-232.
Notice of Reason for Rejection received for Japanese Patent Application No. 2019502689, dated Feb. 7, 2022, 9 pages (5 pages of English Translation and 4 pages of Original Document).
Fornier et al., Update on the Management of Advanced Breast Cancer, Oncology Journal, 1999, 13, 647-658.
Idusogie et al., "Engineered Antibodies with Increased Activity to Recruit Complement", 2001, 166, 2571-2575.
Idusogie et al., Mapping of the C1q Binding Site on Rituxan, a chimeric Antibody with a Human IgG1 Fc, 2000, 164, 4178-4184.

ANTI-CD47 COMBINATION THERAPY

CROSS-REFERENCE TO RELATED APPLICATIONS

This application is the National Stage Application of International Patent Application No. PCT/AU2017/000150 filed Jul. 19, 2017, which claims priority to U.S. Provisional Patent Application No. 62/363,982, filed 19 Jul. 2016, the entire disclosures of each of which are incorporated herein in their entirety by cross reference.

SEQUENCE LISTING

The instant application contains a Sequence Listing which has been filed electronically in ASCII format and is hereby incorporated by reference in its entirety. Said ASCII copy, created on Aug. 22, 2019, is named 101017_000013_SL.txt and is 1,406,251 bytes in size.

FIELD OF INVENTION

The present invention relates to a combination therapy for the treatment of tumors. The combination comprises a first and second moiety where the two moieties function in conjunction to provide a heightened anti-tumor response. The first moiety is a polypeptide construct comprising an attenuated Type I interferon linked to an antibody which binds to a cell surface-associated antigen expressed on the tumor cell and the second moiety is an agent that reduces CD47 signaling.

BACKGROUND OF INVENTION

Numerous peptide and polypeptide molecules have been described to function by interacting with a receptor on a cell surface, and thereby stimulating, inhibiting, or otherwise modulating a biological response, usually involving signal transduction pathways inside the cell that bears the said receptor. Examples of such molecules include peptide and polypeptide hormones, cytokines, chemokines, growth factors, apoptosis-inducing factors and the like. These molecules can be either soluble or can be attached to the surface of another cell.

Due to the biological activity of such molecules, some have potential use as therapeutics. Several peptide or polypeptide molecules have been approved by regulatory agencies as therapeutic products, including, for example, human growth hormone, insulin, interferon IFNα2b, IFNα2a, IFNβ, IFNγ, erythropoietin, G-CSF and GM-CSF. Many of these and other peptides have demonstrated potential in therapeutic applications, but have also exhibited toxicity when administered to human patients. One reason for toxicity is that most of these molecules trigger receptors on a variety of cells, including cells other than those that mediate the desired therapeutic effect. For example, when IFNα2b is used to treat multiple myeloma its utility resides, at least in part, in its binding to type I interferon receptors on the myeloma cells, which in turn triggers reduced proliferation and hence limits disease progression. Unfortunately, however, this IFN also binds to numerous other, normal cells within the body, triggering a variety of other cellular responses which are undesirable in the therapeutic setting, some of which are harmful (e.g. flu-like symptoms, neutropenia, depression). A consequence of such "off target" activity of peptides is that many peptides are not suitable as drug candidates. In this context, "off target activity" refers to activity on the peptide's natural receptor, but on the surface of cells other than those that mediate therapeutically beneficial effects.

Even though some peptides, such as IFNα2b, are approved for the treatment of medical conditions, they are poorly tolerated due to their "off target" biological activity. The off-target activity and associated poor tolerability also mean that some of these peptide based drugs cannot be administered at sufficiently high dosages to produce optimal therapeutic effects on the target cells which mediate the therapeutic effect.

Similarly, it has been known since the mid-1980's that interferons, in particular IFNα, are able to increase apoptosis and decrease proliferation of certain cancer cells. These biological activities are mediated by type I interferon receptors on the surface of the cancer cells which, when stimulated, initiate various signal transduction pathways leading to reduced proliferation and/or the induction of terminal differentiation or apoptosis. IFNα has been approved by the FDA for the treatment of several cancers including melanoma, renal cell carcinoma, B cell lymphoma, multiple myeloma, chronic myelogenous leukemia (CML) and hairy cell leukemia. A "direct" effect of IFNα on the tumor cells is mediated by the IFNα binding directly to the type I IFN receptor on those cells and stimulating apoptosis, terminal differentiation or reduced proliferation. One "indirect" effect of IFNα on non-cancer cells is to stimulate the immune system, which may produce an additional anti-cancer effect by causing the immune system to reject the tumor.

Unfortunately, the type I interferon receptor is also present on most non-cancerous cells. Activation of this receptor on non-cancerous cells by an IFNα causes the expression of numerous pro-inflammatory cytokines and chemokines, leading to toxicity. Such toxicity prevents the dosing of IFNα to a subject at levels that exert the maximum antiproliferative and pro-apoptotic activity on the cancer cells.

Ozzello et al. (Breast Cancer Research and Treatment 25:265-76, 1993) described covalently attaching human IFNα to a tumor-targeting antibody, thereby localizing the direct inhibitory activity of IFNα to the tumor as a way of reducing tumor growth rates, and demonstrated that such conjugates have anti-tumor activity in a xenograft model of a human cancer. The mechanism of the observed anti-cancer activity was attributed to a direct effect of IFNα on the cancer cells, since the human IFNα used in the experiments did not interact appreciably with the murine type I IFN receptor, which could have led to an indirect anti-cancer effect. Because of this lack of binding of the human IFNα to the murine cells, however, the authors could not evaluate the toxicity of the antibody-IFNα conjugate relative to free IFNα. These authors used a chemical method to attach the IFNα to the antibody.

Alkan et al., (Journal of Interferon Research, volume 4, number 3, p. 355-63, 1984) demonstrated that attaching human IFNα to an antibody that binds to the Epstein-Barr virus (EBV) membrane antigen (MA) increased its antiproliferative activities towards cells that express the EBV-MA antigen. This increased potency was dependent on both antigen expression by the target cells and the binding specificity of the antibody. The cell line tested was the cancer cell line QIMR-WIL, a myeloblastic leukemia. The authors suggested that the attachment of IFNα to an antibody could be used as a treatment for cancer since it would reduce tumor growth. Alkan et al did not address the potential toxicity of these antibody-IFNα conjugates arising from their interactions with normal, antigen-negative cells.

It is also known that the linkage between an antibody and IFNα may be accomplished by making a fusion protein construct. For example, IDEC (WO01/97844) disclose a direct fusion of human IFNα to the C terminus of the heavy chain of an IgG targeting the tumor antigen CD20. Other groups have disclosed the use of various linkers between the C-terminus of an IgG heavy chain and the IFNα. For example, U.S. Pat. No. 7,456,257 discloses that the C-terminus of an antibody heavy chain constant region may be connected to IFNα via an intervening serine-glycine rich (S/G) linker of the sequence (GGGGS)$_n$, where n may be 1, 2 or 3 (SEQ ID NO: 539), and that there are no significant differences in the IFNα activity of the fusion protein construct regardless of linker length.

Morrison et al. (U.S. Pat. No. 8,563,692; and Xuan C, Steward K K, Timmerman J M, Morrison S L. Targeted delivery of interferon-a via fusion to anti-CD20 results in potent antitumor activity against B-cell lymphoma. Blood 2010; 115:2864-71) also disclose IFNα linked to the C-terminus of the heavy chain of a cancer-targeting IgG antibody, with an intervening S/G linker, and observed that the fusion of the IgG and linker to the IFNα reduced the activity of IFNα on cells that did not express the corresponding antigen on the cell surface. The decreased IFN activity of these fusion protein constructs was modest when compared to human non-fusion protein IFNα (free IFNα) acting on human cells, but appeared to be more significant for murine IFNα on murine cells. The decrease in the activity of human IFNα that results from fusing it to the C-terminus of an antibody, as observed by Morrison et al, and in U.S. Pat. No. 7,456,257 is modest and is generally considered to be a disadvantage since it reduces potency of the IFN. This disadvantage was pointed out, for example, by Rossi et al (Blood vol. 114, No. 18, pp 3864-71), who used an alternative strategy of attaching the IFNα to a tumor targeting antibody in such a way that no loss in IFNα activity was observed.

In general the prior art teaches to use a potent IFN and to target this IFN to cancer cells. While this approach results in an increase in activity of the IFN against cancer cells, it does not address the issue of activity of the IFN on normal "off-target" cells. In prior art examples referred to above, the human IFNα portion of the antibody-IFNα fusion protein largely maintained the native IFNα activity when exposed to human cells that did not express the corresponding antigen on their cell surfaces. This maintenance of activity may lead to toxicity arising from the activation of non-cancerous, normal ("off target") cells by the IFNα portion of the fusion protein.

Accordingly, there exists a need to decrease the "off-target" activity of IFN-based drugs, while retaining the "on-target", therapeutic effect of such drugs. The maintenance of target-specific activity and at the same time a reduction in non-target toxicity of these types of therapeutic agents would create a greater therapeutic concentration window for therapeutically useful peptides. It would for example be desirable to use human IFNα in a form such that its activity can be directed to the cancer cells while minimizing its effects on normal human cells. Ideally the type I interferon receptor on the cancer cells would be maximally stimulated, while the same receptor on non-cancerous cells would experience minimal stimulation. There is a need to target human IFNα to the cancer cells in such a way that it has dramatically more activity on the cancer cells, which display the antigen, than on the normal cells, which do not display the antigen. The same logic applies to other potentially therapeutic molecules, e.g. other cytokines, peptide and polypeptide hormones, chemokines, growth factors, apoptosis-inducing factors and the like.

The logic of this approach has been demonstrated in WO 2013/059885, WO 2014/178820 and WO 2016/065409, the disclosure of each of which is incorporated herein by cross reference.

Macrophages are innate immune cells that reside in all tissues. In cancer, macrophages can promote or inhibit tumor growth depending on cellular signals. Characterization of subsets of macrophages has revealed at least 2 subsets; one subset, M2 macrophages, produces arginase and promotes tumor growth while another subset, M1 macrophages, produces nitrous oxide synthetase and mediates tumor killing. Macrophages can kill via antibody dependent mechanisms such as antibody-dependent cellular phagocytosis (ADCP) or antibody independent mechanisms.

Unlike healthy cells, unwanted, aged or dying cells display markers or ligands called "eat-me" signals, i.e. "altered self", which can in turn be recognized by receptors on phagocytes such as neutrophils, monocytes and macrophages. Healthy cells may display "don't eat-me" signals that actively inhibit phagocytosis; these signals are either downregulated in the dying cells, are present in an altered conformation or they are superseded by the upregulation of "eat-me" or pro-phagocytic signals. The cell surface protein CD47 on healthy cells and its engagement with a phagocyte receptor, Signal Regulatory Protein α (SIRPα), constitutes a key "don't eat-me" signal which can turn off engulfment mediated by multiple modalities, including apoptotic cell clearance and FcR mediated phagocytosis. Blocking the CD47 mediated engagement of SIRPα on a phagocyte, or the loss of CD47 expression in knockout mice, can cause removal of live cells and non-aged erythrocytes. Blocking SIRPα also allows engulfment of targets that are not normally phagocytosed, for those cells where pre-phagocytic signals are also present.

CD47 is a broadly expressed transmembrane glycoprotein with a single Ig-like domain and five membrane spanning regions. CD47 functions as a cellular ligand for SIRPα, with binding mediated through the NH2-terminal V-like domain of SIRPα. SIRPα is expressed primarily on myeloid cells, including macrophages, granulocytes, myeloid dendritic cells (DCs), mast cells, and their precursors, including hematopoietic stem cells. Structural determinants on SIRPα that mediate CD47 binding are discussed by Lee et al. (2007) J. Immunol. 179:7741-7750; Hatherley et al. (2007) J.B.C. 282:14567-75; and the role of SIRPα cis dimerization in CD47 binding is discussed by Lee et al. (2010) J.B.C. 285:37953-63. In keeping with the role of CD47 to inhibit phagocytosis of normal cells, there is evidence that it is transiently upregulated on hematopoietic stem cells (HSCs) and progenitors just prior to and during their migratory phase, and that the level of CD47 on these cells determines the probability that they are engulfed in vivo.

Programmed cell death (PCD) and phagocytic cell removal are amongst the ways that an organism responds in order to remove damaged, precancerous, or infected cells. Thus, the cells that survive this organismal response (e.g., cancerous cells, chronically infected cells, etc.) have devised ways to evade PCD and phagocytic cell removal. CD47, the "don't eat me" signal, is constitutively upregulated on a wide variety of diseased cells, cancer cells, and infected cells, allowing these cells to evade phagocytosis. Anti-CD47 agents that block the interaction between CD47 on one cell (e.g., a cancer cell, an infected cell, etc.) and SIRPα on another cell (e.g., a phagocytic cell) counteract the increase of CD47 expression and facilitate the phagocytosis of the cancer cell and/or the infected cell. Thus, anti-CD47 agents can be used to treat and/or protect against a wide variety of conditions/disorders.

SUMMARY OF INVENTION

In a first aspect the present invention provides a combination therapy for treating a tumor in a subject, the combination therapy comprising administration of (i) a polypeptide construct comprising an attenuated Type I interferon (IFN) linked to an antibody which binds to a cell surface-associated antigen expressed on the tumor cell and which comprises a functional Fc region and (ii) a CD47 antagonist which inhibits the interaction CD47 with the SIRPα receptor.

In the combination therapy of the present invention components (i) and (ii) may be administered sequentially or simultaneously.

In a second aspect the present invention provides a method of treating a tumor in a subject comprising using the combination therapy of the present invention.

In a third aspect the present invention provides a composition comprising components (i) and (ii) of the combination therapy of the present invention in admixture.

In a fourth aspect the present invention provides the use of components (i) and (ii) of the combination therapy of the present invention in the preparation of a medicament(s) for the treatment of a tumor.

DETAILED DESCRIPTION OF THE INVENTION

Figure 1:
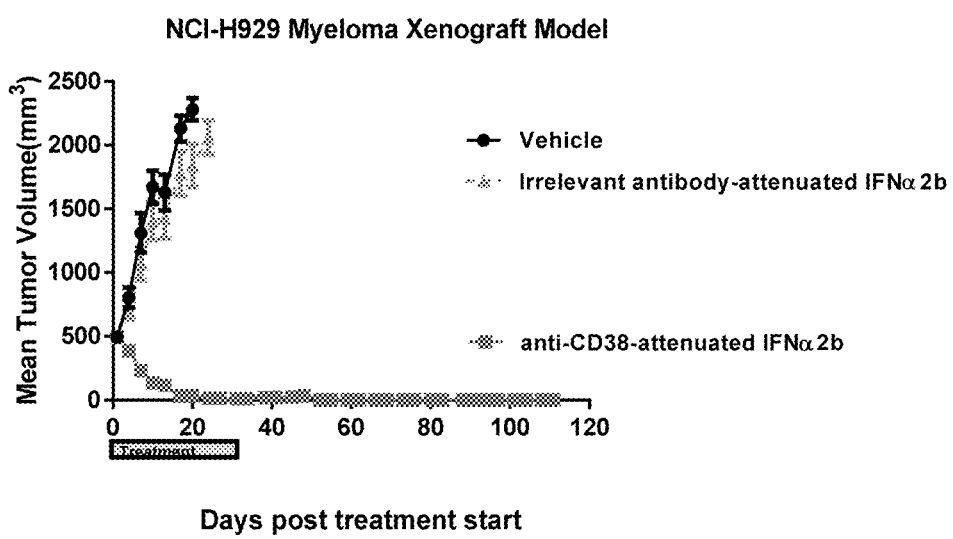
FIG. 1: Graph of tumor volumes in an NCI-H929 myeloma xenograft model showing results of treatment with an anti-CD38-attenuated IFNα2b fusion protein compared to an isotype control-attenuated IFNα2b antibody (irrelevant antibody-attenuated IFNα2b). Treatment with the anti-CD-38-IFNα2b fusion protein eliminated the NCI-H929 tumors in 10 of 10 mice, while the activity of the control non-targeted attenuated IFNα2b fusion protein showed little to no effect.

Throughout this specification, unless the context requires otherwise, the word "comprise", or variations such as "comprises" or "comprising", will be understood to imply the inclusion of a stated element or integer or group of elements or integers but not the exclusion of any other element or integer or group of elements or integers.

The reference in this specification to any prior publication (or information derived from it), or to any matter which is known, is not, and should not be taken as an acknowledgment or admission or any form of suggestion that prior publication (or information derived from it) or known matter forms part of the common general knowledge in the field of endeavor to which this specification relates.

All publications mentioned in this specification are herein incorporated by reference in their entirety.

It must be noted that, as used in the subject specification, the singular forms "a", "an" and "the" include plural aspects unless the context clearly dictates otherwise. Thus, for example, reference to "an agent" includes a single agent, as well as two or more agents; reference to "a molecule" includes a single molecule, as well as two or more molecules; and so forth.

In a first aspect the present invention provides a combination therapy for treating a tumor in a subject, the combination therapy comprising administration of (i) a polypeptide construct comprising an attenuated Type I interferon (IFN) linked to an antibody which binds to a cell surface-associated antigen expressed on the tumor cell and comprising a functional Fc region and (ii) a CD47 antagonist which inhibits the interaction of CD47 with the SIRPα receptor.

In the combination therapy of the present invention components (i) and (ii) may be administered sequentially or simultaneously.

In a second aspect the present invention provides a method of treating a tumor in a subject comprising using the combination therapy of the present invention.

In a third aspect the present invention provides a composition comprising components (i) and (ii) of the combination therapy of the present invention in admixture.

In a fourth aspect the present invention provides the use of components (i) and (ii) of the combination therapy of the present invention in the preparation of a medicament(s) for the treatment of a tumor. The components may be administered in admixture or sequentially in either order. The invention extends to the use of component (i) in the preparation of a medicament for use with component (ii) in the treatment of a tumor and the use of component (ii) in the preparation of a medicament for use with component (i) in the treatment of a tumor.

As will be clear it is a feature of the present invention that the antibody which binds to the cell surface-associated antigen expressed on the tumor cell comprises a functional Fc region. As used herein the term "functional Fc region" means that the Fc region possess the ability to elicit effector function by interacting with Fcγ receptors on macrophages. In particular the functional Fc is capable of promoting phagocytosis by macrophages via antibody-dependent cellular phagocytosis (ADCP) and/or cell killing via antibody dependent cell-mediated cytotoxicity (ADCC). Complement fixation is also a function of the Fc receptor.

As will also be clear, it is a feature of the present invention that the Type I interferon is attenuated. As used herein the term "attenuated Type I IFN" means that the sequence of the Type I IFN is altered (mutated) in manner to reduce the potency of the Type I interferon for a cell possessing an IFN receptor relative to wild-type Type I interferon. This reduced potency may be due to decreased affinity of the attenuated Type 1 IFN for the IFN receptor relative to wild-type Type I IFN. The potency of a Type I IFN may be quantitatively represented by the EC50 value, which is the mathematical midpoint of a dose-response curve, in which the dose refers to the concentration of Type I IFN antibody-Type I IFN construct in an assay, and response refers to the quantitative response of the cells to the signaling activity of the IFN at a particular dose. For a Type I IFN a cell-based Interferon Response Element (IRE) reporter assay, caspase or cell proliferation response may be used for example to determine potency.

In certain embodiments the attenuated Type I IFN is linked to the antibody via a peptide bond. This linkage may be direct or via a linker of 1 to 20 amino acids in length. Typically the attenuated Type I IFN will be linked to the C-terminus of the light chain or heavy chain constant region of the antibody.

It is preferred that the attenuated Type I IFN is attenuated IFNα.

The attenuated IFNα may comprise an amino acid sequence selected from SEQ ID NOs 1 to 3, 80 to 90, 391 and 392. This sequence will also include at least one amino acid substitution or deletion which attenuates the IFNα activity.

In certain embodiments the attenuated IFNα is attenuated IFNα2b. An exemplary wild type IFNα2b sequence is shown in SEQ ID NO:3 and in certain embodiments the attenuated IFNα2b comprises, relative to wild type, at least one amino acid substitution or deletion selected from the group consisting of L15A, R22A, R23A, S25A, L26A, F27A, L30A, L30V, K31A, D32A, R33A, R33K, R33Q, H34A, Q40A, D114R, L117A, R120A, R120E, R125A, R125E, K131A, E132A, K133A, K134A, M148A, R149A, S152A, L153A, N156A, (L30A, H57Y, E58N and Q61S), (R33A, H57Y, E58N and Q61S), (M148A, H57Y, E58N and Q61S), (L153A, H57Y, E58N and Q61S), (R144A, H57Y, E58N and Q61S), (N65A, L80A, Y85A and Y89A) (N65A, L80A, Y85A, Y89A and D114A), (N65A, L80A, Y85A, Y89A and L117A), (N65A, L80A, Y85A, Y89A and R120A), (Y85A, Y89A and D114A), (D114A and R120A), (L117A and R120A), (L117A, R120A and K121A), (R120A and K121A), (R120E and K121E), replacement of R at position 144 with A, D, E, G, H, I, K, L, N, Q, S, T, V or Y, replacement of A at position 145 with D, E, G, H, I, K, L, M, N, Q, S, T, V or Y, deletion of residues L161 to E165, and combinations thereof. A preferred mutation, relative to wild type, is A145D and an example of such an attenuated IFNα2b is shown in SEQ ID NO: 44 and SEQ ID NO:536.

As will be recognized by those skilled in the art where a different IFNα2b sequence is used the mutations referred to above will be made in corresponding positions from the wild-type IFNα2b sequence.

The attenuated IFNα2b may also be aglycosylated attenuated IFNα2b. The residue T106 of the aglycosylated attenuated IFNα2b may be deleted or substituted with an amino acid other than T in order to remove a site of glycosylation when the IFNα2b is produced in a mammalian cell.

In another embodiment the cell surface-associated antigen is selected from the group consisting of CD38, CD138, RANK-Ligand, HM1.24, CD56, CS1, CD20, CD74, IL-6R, Blys (BAFF), BCMA, Kininogen, beta2 microglobulin, FGFR3, ICAM-1, matriptase, CD52, EGFR, GM2, alpha4-integrin, IFG-1R, KIR, CD3, CD4, CD8, CD24, CD30, CD37, CD44, CD69, CD71, CD79, CD83, CD86, CD96, HLA, PD-1, ICOS, CD33, CD115, CD11c, CD19, CD52, CD14, FSP1, FAP, PDGFR alpha, PDGFR beta, ASGR1, ASGR2, FSP1, LyPD3, RTI140/Ti-alpha, HTI56, VEGF receptor, CD241 the product of the RCHE gene, CD117 (c-kit), CD71 (transferrin receptor), CD36 (thrombospondin receptor), CD34, CD45RO, CD45RA, CD115, CD168, CD235, CD236, CD237, CD238, CD239, CD240 TROP2, CD70, CCR2, HER2, EGFR, IGF1R, CEA and CCR3.

In some embodiments cell surface associated antigens include CD38, CD138, EpCAM, TROP2, CD19, CD20, CD79b, CD22 and CD52.

In a more particular embodiment the cell surface-associated antigen is CD38. In certain embodiments the $V_H$ sequence of the antibody is selected from the group consisting of SEQ ID Nos: 342, 344, 346, 504 and 511 and the $V_L$ sequence of the antibody is selected from the group consisting of SEQ ID Nos: 341, 343, 345, 505, 512 and 533; as well as related antibodies of any combination of the foregoing $V_H$ and $V_L$ sequences. An antibody that is a "related antibody" (which encompasses a "related antigen-binding fragment") of a reference antibody encompasses antibodies (and antigen-binding fragments thereof) that: compete with the reference antibody for binding the target antigen (e.g., in some embodiments, competition for the same, overlapping, or adjacent epitopes), have the epitopic specificity of the reference antibody, comprise the complementarity determining regions (CDRs) of the reference antibody (in some embodiments, there may be up to 1, 2, 3, 4, or 5 conservative amino acid substitutions in the whole of the CDRs, or up to 1 or 2 conservative substitutions in each CDR), or comprise the variable heavy and variable light domains of the reference antibody (or may have at least 80, 85, 90, 95, 96, 97, 98, 99%, or more amino acid identity to the variable domains, where any amino acid changes are in the framework region and may be conservative or non-conservative). In some embodiments, conservative substitutions are determined by BLASTp's default parameters, while, in other embodiments, conservative mutations are within class substitutions, where the classes are aliphatic (glycine, alanine, valine, leucine, isoleucine), hydroxyl or sulphur/selenium-containing (serine, cysteine, selenocysteine, threonine, methionine), cyclic (proline), armotaic (phenylalanine, tyrosine, tryptophan), basic (histidine, lysine, arginine), and acidic and amides (aspartate, glutamate, asparagine, glutamine). Those of skill in this art recognize that, in general, single amino acid substitutions in non-essential regions of a polypeptide do not substantially alter biological activity (see, e.g., Watson et al. (1987) Molecular Biology of the Gene, The Benjamin/Cummings Pub. Co., p. 224 (4th Ed.)). In addition, substitutions of structurally or functionally similar amino acids are less likely to disrupt biological activity.

In a particular embodiment the $V_H$ sequence is SEQ ID NO:504 and the $V_L$ sequence is SEQ ID NO:535.

In certain particular embodiments, the sequence of the polypeptide construct is SEQ ID NO:532 and SEQ ID NO:533, or an amino acid sequence at least 80, 85, 90, 95, 96, 97, 98, 99%, or more identical to SEQ ID NO:532 and SEQ ID NO:533, preferably comprising the aforementioned mutations.

In certain embodiments the CD47 antagonist binds CD47 and inhibits its interaction with the SIRPα receptor. In these embodiments the CD47 antagonist may be an anti-CD47 antibody, preferably a human antibody or a humanized monoclonal antibody Examples of anti-CD47 antibodies include those disclosed in WO2017/053423, US 2013/0224188 and antibodies known as 5F9 (Wang et al, 2015, PLoS ONE 10(9): e0137345), ZF1 (Zeng et al, Oncotarget, 2016, Vol 7, 83040-8350), INBRX-103 (CC-90002) (Celgene), Hu5f9-G4 (Forty Seven Inc.), NI-1701 (Novimmune), NI-1801 (Novimmune), and SRF231 (Surface Oncology).

In certain embodiments the sequence of the anti-CD47 antibody is provided in SEQ ID NO:509/510, 513/514, 515/516, 517/518, 519/520 and 509/534 and related antibodies.

The CD47 antagonist may also be an anti-SIRPα antibody. Such an anti-SIRPα antibody may also be a human antibody or a humanized monoclonal antibody. An example of such an antibody is Effi-DEM (OSE Immunotherapeutics).

In another option the CD47 antagonist may be the extracellular domain of SIRPα. The extracellular domain of SIRPα may be attached to an Fc. An example of such a fusion protein is TTI-621 (Petrova et al, Clin Cancer Res, 2016; DOI: 10.1158/1078-0432.CCR-16-1700)

A further discussion of known antagonists which inhibit the interaction CD47 with the SIRPα receptor is provided in Weiskopf, European Journal of Cancer, 2017, 76:100-109, Sockolosky et al, PNAS, 2016, 10.1073, E2646-E2654, and Sick et al, 2012, 167, 1415-1430. The disclosure of these references is included herein by cross reference.

Components (i) and (ii) of the combination therapy may be administered sequentially or simultaneously. If administration is sequential, either component (i) may be administered before component (ii), or component (ii) may be administered before component (i).

In certain embodiments the constructs of the present invention are antibody-attenuated aglycosylated IFNα2b fusion constructs, which show an elevated antigen-selectivity index with respect to activating signaling pathways due to the action of both the antibody targeting to a cell surface receptor on a cell of interest and the attenuated IFNα2b having reduced affinity to a cell surface IFN receptor. These constructs are based on the discovery outlined in WO 2013/059885 and are disclosed more fully in WO 2016/065409. As explained in these documents in the antibody-IFN fusion construct the IFN portion is mutated in such a way that the IFN activity on antigen-negative cells is dramatically attenuated, while the IFN activity on antigen-positive cells is only modestly, if at all, attenuated. Such constructs display one, two, three, four or five orders of magnitude greater potency on antigen-positive cells compared to antigen negative cells. In one embodiment, the antibody-attenuated IFN construct retains at least 1%, at least 10%, at least 20%, at least 30%, at least 40% or at least 50% of the potency on antigen-positive cells as the non-attenuated free (i.e. not attached to an antibody) IFN. In addition, in one embodiment the antibody-attenuated IFN construct retains at least 30%, at least 50%, at least 75% or at least 90% of the maximal activity of the non-attenuated free (i.e. not attached to an antibody) IFN; in this context, "maximal activity" should be understood as meaning the amount of signaling activity (or downstream effect thereof) at the high, plateau portion of a dose-response curve, where further increases in the agent does not further increase the amount of response).

As explained in WO 2016/065409 an advantage is obtained using attenuated aglycosylated IFNα2b in the constructs of the present invention. Accordingly in certain embodiments these attenuated cytokines are preferred.

As will be understood examples of Type I interferons are IFN-α (alpha), which comes in various forms (IFN-α1, IFN-α2, IFN-α4, IFN-α5, IFN-α6, IFN-α7, IFN-α8, IFN- α10, IFN-α13, IFN-α14, IFN-α16, IFN-α17 and IFN-α21), IFN-β (beta), IFN-κ (kappa), IFN-δ (delta), IFN-ε (epsilon), IFN-τ (tau), IFN-ω (omega), and IFN-ζ (zeta, also known as limitin).

The invention also contemplates the combination therapy of the present invention with other drugs and/or in addition to other treatment regimens or modalities such as radiation therapy or surgery. When the constructs of the present invention are used in combination with known therapeutic agents the combination may be administered either in sequence (either continuously or broken up by periods of no treatment) or concurrently or as an admixture. In the case of cancer, there are numerous known anticancer agents that may be used in this context. Treatment in combination is also contemplated to encompass the treatment with either the construct of the invention followed by a known treatment, or treatment with a known agent followed by treatment with the construct of the invention, for example, as maintenance therapy. For example, in the treatment of cancer it is contemplated that the constructs of the present invention may be administered in combination with an alkylating agent (such as mechlorethamine, cyclophosphamide, chlorambucil, ifosfamidecysplatin, or platinum-containing alkylating-like agents such as cysplatin, carboplatin and oxaliplatin), an antimetabolite (such as a purine or pyrimidine analogue or an antifolate agent, such as azathioprine and mercaptopurine), an anthracycline (such as Daunorubicin, Doxorubicin, Epirubicin Idarubicin, Valrubicin, Mitoxantrone, or anthracycline analog), a plant alkaloid (such as a vinca alkaloid or a taxane, such as Vincristine, Vinblastine, Vinorelbine, Vindesine, paclitaxel or Dosetaxel), a topoisomerase inhibitor (such as a type I or type II topoisomerase inhibitor), a Podophyllotoxin (such as etoposide or teniposide), or a tyrosine kinase inhibitor (such as imatinib mesylate, Nilotinib, or Dasatinib). In particular anthracyclines are known to initiate an interferon response in breast tumor cells, inducing CXCL5 production and macrophage chemotaxis and activation. Tumor localized administration of IFN in combination with CD47 blockade is expected to increase the effectiveness of these agents.

In the case of the treatment of multiple myeloma, it is contemplated that the combination of the present invention may be administered in combination with current therapies, such as steroids such as dexamethasone, proteasome inhibitors (such as bortezomib or carfilzomib), immunomodulatory drugs (such as thalidomide, lenalidomide or pomalidomide), with or without other chemotherapeutic agents such as Melphalan hydrochloride or the chemotherapeutic agents listed above.

In the case of the treatment of Hodgkin's lymphoma, it is contemplated that the combination of the present invention may be administered in combination with current therapeutic approaches, such as ABVD (Adriamycin (doxorubicin), bleomycin, vinblastine, and dacarbazine), or Stanford V (doxorubicin, bleomycin, vinblastine, vincristine, mechlorethamine, etoposide, prednisone), or BEACOPP (doxorubicin, bleomycin, vincristine, cyclophosphamide, procarbazine, etoposide, prednisone).

In the case of non-Hodgkin's lymphoma or other lymphomas, it is contemplated that the combination of the present invention may be administered in combination current therapeutic approaches. Examples of drugs approved for non-Hodgkin lymphoma include Abitrexate (Methotrexate), Adriamycin PFS (Doxorubicin Hydrochloride), Adriamycin RDF (Doxorubicin Hydrochloride), Ambochlorin (Chlorambucil), Amboclorin (Chlorambucil), Arranon (Nelarabine), Bendamustine Hydrochloride, Bexxar (Tositumomab and Iodine I 131 Tositumomab), Blenoxane (Bleomycin), Bleomycin, Bortezomib, Chlorambucil, Clafen (Cyclophosphamide), Cyclophosphamide, Cytoxan (Cyclophosphamide), Denileukin Diftitox, DepoCyt (Liposomal Cytarabine), Doxorubicin Hydrochloride, DTIC-Dome (Dacarbazine), Folex (Methotrexate), Folex PFS (Methotrexate), Folotyn (Pralatrexate), Ibritumomab Tiuxetan, Istodax (Romidepsin), Leukeran (Chlorambucil), Linfolizin (Chlorambucil), Liposomal Cytarabine, Matulane (Procarbazine Hydrochloride), Methotrexate, Methotrexate LPF (Methotrexate), Mexate (Methotrexate), Mexate-AQ (Methotrexate), Mozobil (Plerixafor), Nelarabine, Neosar (Cyclophosphamide), Ontak (Denileukin Diftitox), Plerixafor, Pralatrexate, Rituxan (Rituximab), Rituximab, Romidepsin, Tositumomab and Iodine I 131 Tositumomab, Treanda (Bendamustine Hydrochloride), Velban (Vinblastine Sulfate), Velcade (Bortezomib), and Velsar (Vinblastine Sulfate), Vinblastine Sulfate, Vincasar PFS (Vincristine Sulfate), Vincristine Sulfate, Vorinostat, Zevalin (Ibritumomab Tiuxetan), Zolinza (Vorinostat). Examples of drug combinations used in treating non-Hodgkin lymphoma include CHOP (C=Cyclophosphamide, H=Doxorubicin Hydrochloride (Hydroxydaunomycin), O=Vincristine Sulfate (Oncovin), P=Prednisone); COPP (C=Cyclophosphamide, O=Vincristine Sulfate (Oncovin), P=Procarbazine Hydrochloride, P=Prednisone); CVP (C=Cyclophosphamide, V=Vincristine Sulfate, P=Prednisone); EPOCH (E=Etoposide, P=Prednisone, O=Vincristine Sulfate (Oncovin), C=Cyclophosphamide, H=Doxorubicin Hydrochloride (Hydroxydaunomycin)); ICE (I=Ifosfamide, C=Carboplatin, E=Etoposide) and R-CHOP (R=Rituximab, C=Cyclophosphamide, H=Doxorubicin Hydrochloride (Hydroxydaunomycin), O=Vincristine Sulfate (Oncovin), P=Prednisone.

Combination of retinoids with the combination of the present invention is also contemplated. Retinoids are a family of molecules that play a major role in many biological functions including growth, vision, reproduction, epithelial cell differentiation and immune function (Meyskens, F. et al. Crit Rev Oncol Hematol 3:75, 1987, Herold, M. et al. Acta Dermatovener 74:29 1975). Early preclinical studies with the retinol all-trans retinoic acid or ATRA, either alone or in combination with other agents, demonstrated activity against acute promyelocytic leukemia (APL), myelodysplastic syndrome, chronic myelogenous leukemia (CML), mycosis fungoides and multiple myeloma (reviewed in Smith, M. J. Clin. Oncol. 10:839, 1992). These studies led to the approval of ATRA for the treatment of APL. Currently there are over 100 clinical trials evaluating the activity of ATRA in combination with other therapies for the treatment of hematological malignancies, kidney cancers, lung cancers, squamous cell carcinomas and more. Of particular interest and pertaining directly to this invention are the studies demonstrating enhanced efficacy of interferon-α treatment when combined with ATRA. This is described for mantle cell lymphoma (Col, J. et al. Cancer Res. 72:1825, 2012), renal cell carcinoma (Aass, N. et al. J. Clin. Oncol. 23:4172, 2005; Motzer, R. J. Clin. Oncol. 18:2972, 2000), CML, melanoma, myeloma and renal cell carcinoma (Kast, R. Cancer Biology and Therapy, 7:1515, 2008) and breast cancer (Recchia, F. et al. J. Interferon Cytokine Res. 15:605, 1995). The present inventors therefor predict enhanced activity of the combination of our targeted attenuated IFNs and CD47 blockade when combined with therapeutic dosing of ATRA in the clinic. In addition, Mehta (Mol Cancer Ther 3(3):345-52, 2004) demonstrated that in vitro treatment of leukemia cells with retinoic acid induced expression of CD38 antigen. Thus, the enhanced efficacy of interferon plus the induced expression of the target CD38 would indicate a combination therapy of ATRA with our anti-CD38 antibody-attenuated IFNα in the treatment of IFN-sensitive cancers that express CD38 or may be induced by ATRA to express CD38. Examples of such cancers are multiple myeloma, non-Hodgkin's lymphoma, CML and AML.

Type I IFNs can have anti-cancer activity based on a direct stimulation of the type I IFN receptor on cancer cells. This has been shown for numerous types of cancer including multiple myeloma, melanoma, B cell lymphoma, non-small cell lung cancer, renal cell carcinoma, hairy cell leukemia, chronic myelogenous leukemia, ovarian cancer, fibrosarcoma, cervical cancer, bladder cancer, astrocytoma, pancreatic cancer, etc (Borden, Cancer Research 42:4948-53, 1982; Chawla-Sarkar, Clinical Cancer Research 7: 1821-31, 2001; Morgensen, Int J. Cancer 28:575-82, 1981; Otsuka, British Journal of Haematology 103:518-529, 1998; Lindner, J of Interferon and Cytokine Research 17:681-693, 1997; Caraglia, Cell Death and Differentiation 6:773-80, 1999; Ma, World J Gastroenterol 11(10):1521-8, 2005). One of skill in the art will recognize that the present invention has many aspects resulting from the combination of CD47 blockade with antibodies to tumor associated antigens fused with attenuated type I interferons, and that the resulting fusion protein constructs may be used to reduce the proliferation of various interferon-sensitive cancers that express the corresponding tumor associated antigens.

Many other examples of signaling ligands are also known in the art and may, as described in the non-limiting exemplary embodiments above, be attenuated and attached to an antibody that binds to an antigen on specific target cells, thereby allowing the ligand to generate its biological signal on those target cells to a much greater degree than it generates its signal on antigen-negative cells. Examples of ligands that have a tumorigenic macrophage induction or stimulation activity include TNFα, Fas Ligand, IFNβ, IFNγ or IFNλ, which can be targeted to various tumor cell surface antigens as discussed above for IFNα and combined with CD47 blockade.

The term "antibody", as used herein, broadly refers to any immunoglobulin (Ig) molecule comprised of four polypeptide chains, two heavy (H) chains and two light (L) chains, or any functional fragment, mutant, variant, or derivation thereof, which retains the essential epitope-binding features of an Ig molecule. Such mutant, variant, or derivative antibody formats are known in the art, non-limiting embodiments of which are discussed below.

In a full-length antibody, each heavy chain is comprised of a heavy chain variable region (abbreviated herein as HCVR or $V_H$) and a heavy chain constant region. The heavy chain constant region is comprised of three domains, CH1, CH2 and CH3. Each light chain is comprised of a light chain variable region (abbreviated herein as LCVR or $V_L$) and a light chain constant region. The light chain constant region is comprised of one domain, CL, which in humans may be of either the κ or λ class. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG1, IgG2, IgG3, IgG4, IgA1 and IgA2) or subclass.

The term "antigen binding domain" or "antigen binding portion" of an antibody, as used herein, refers to one or more fragments of an antibody or protein that retain the ability to specifically bind to an antigen (e.g., CD38). It has been shown that the antigen-binding function of an antibody can be performed by fragments of a full-length antibody. Such antibody embodiments may also be bispecific, dual specific, or multi-specific formats, specifically binding to two or more different antigens. Examples of binding fragments encompassed within the term "antigen-binding portion" of an antibody include (i) a Fab fragment, a monovalent fragment consisting of the $V_L$, $V_H$, $C_L$ and CH1 domains; (ii) a F(ab')2 fragment, a bivalent fragment comprising two Fab fragments in addition to a portion of the hinge region, linked by a disulfide bridge at the hinge region; (iii) an Fd fragment consisting of the $V_H$ and CH1 domains; (iv) an Fv fragment consisting of the $V_L$ and $V_H$ domains of a single arm of an antibody, (v) a domain antibody (dAb) (Ward et al. 1989 Nature 341 544-6, Winter et al., PCT publication WO 90/05144 A1 herein incorporated by reference), which comprises a single variable domain; and (vi) an isolated complementarity determining region (CDR). Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules (known as single chain Fv (scFv); see e.g., Bird et al. 1988 Science 242 423-6; Huston et al. 1988 Proc Natl Acad Sci USA 85 5879-83). Such single chain antibodies are also intended to be encompassed within the term "antigen-binding portion" of an antibody. Other forms of single chain antibodies, such as diabodies, are also encompassed. Diabodies are bivalent, bispecific antibodies in which $V_H$ and $V_L$ domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al., 1993, Proc. Natl. Acad. Sci. USA 90:6444-6448; Poljak, R. J., et al., 1994, Structure 2:1121-1123). Such antibody binding portions are known in the art (Kontermann and Dubel eds., Antibody Engineering 2001 Springer-Verlag. New York. 790 pp., ISBN 3-540-41354-5). In an embodiment the antibody binding portion is a Fab fragment.

The antibody described herein may be a humanized antibody. The term "humanized antibody" shall be understood to refer to a protein comprising a human-like variable region, which includes CDRs from an antibody from a non-human species (e.g., mouse or rat or non-human primate) grafted onto or inserted into FRs from a human antibody (this type of antibody is also referred to a "CDR-grafted antibody"). Humanized antibodies also include proteins in which one or more residues of the human protein are modified by one or more amino acid substitutions and/or one or more FR residues of the human protein are replaced by corresponding non-human residues. Humanized antibodies may also comprise residues which are found in neither the human antibody or in the non-human antibody. Any additional regions of the protein (e.g., Fc region) are generally human. Humanization can be performed using a method known in the art, e.g., U.S. Pat. Nos. 5,225,539, 6,054,297, 7,566,771 or U.S. Pat. No. 5,585,089. The term "humanized antibody" also encompasses a super-humanized antibody, e.g., as described in U.S. Pat. No. 7,732,578.

The antibody described herein may be human. The term "human antibody" as used herein refers to proteins having variable and, optionally, constant antibody regions found in humans, e.g. in the human germline or somatic cells or from libraries produced using such regions. The "human" antibodies can include amino acid residues not encoded by human sequences, e.g. mutations introduced by random or site directed mutations in vitro (in particular mutations which involve conservative substitutions or mutations in a small number of residues of the protein, e.g. in 1, 2, 3, 4 or 5 of the residues of the protein). These "human antibodies" do not necessarily need to be generated as a result of an immune response of a human, rather, they can be generated using recombinant means (e.g., screening a phage display library) and/or by a transgenic animal (e.g., a mouse) comprising nucleic acid encoding human antibody constant and/or variable regions and/or using guided selection (e.g., as described in or U.S. Pat. No. 5,565,332). This term also encompasses affinity matured forms of such antibodies. For the purposes of the present disclosure, a human protein will also be considered to include a protein comprising FRs from a human antibody or FRs comprising sequences from a consensus sequence of human FRs and in which one or more of the CDRs are random or semi-random, e.g., as described in U.S. Pat. No. 6,300,064 and/or U.S. Pat. No. 6,248,516.

The antibody portions of polypeptides of the present invention may be full length antibodies of any class, preferably IgG1, IgG2 or IgG4. The constant domains of such antibodies are preferably human. The variable regions of such antibodies may be of non-human origin or, preferably, be of human origin or be humanized. Antibody fragments may also be used in place of the full length antibodies.

The term "antibody" also includes engineered antibodies. As will be appreciated there are many variations of engineered antibodies (e.g. mouse monoclonal, chimeric, humanized and human monoclonal antibodies, single chain variable antibody fragments (scFvs), minibodies, aptamers, as well as bispecific antibodies and diabodies as described above).

Single variable region domains (termed dAbs) are, for example, disclosed in (Ward et al., 1989, Nature 341: 544-546; Hamers-Casterman et al., 1993, Nature 363: 446-448; Davies & Riechmann, 1994, FEBS Lett. 339: 285-290).

Minibodies are small versions of whole antibodies, which encode in a single chain the essential elements of a whole antibody. Suitably, the minibody is comprised of the VH and VL domains of a native antibody fused to the hinge region and CH3 domain of the immunoglobulin molecule as, for example, disclosed in U.S. Pat. No. 5,837,821.

In an alternate embodiment, the antibody portion of a polypeptide construct provided by the invention may comprise non-immunoglobulin derived, protein frameworks. For example, reference may be made to (Ku & Schutz, 1995, Proc. Natl. Acad. Sci. USA 92: 6552-6556) which discloses a four-helix bundle protein cytochrome b562 having two loops randomized to create CDRs, which have been selected for antigen binding. Additional non-immunoglobulin scaffolds known in the art include small modular immunopharmaceuticals (see, e.g., U.S. Patent Application Publication Nos. 20080181892 and 20080227958), tetranectins, fibronectin domains, protein A, lipocalins, ankyrin repeats, and thioredoxin. Molecules based on non-immunoglobulin scaffolds are generally produced by in vitro selection of libraries by phage display, ribosome display, or other techniques known in the art to identify high-affinity binding sequences.

Using methods well known in the art it is possible to increase binding, by for example, affinity maturation, or to decrease immunogenicity by removing predicted MHC class II-binding motifs. The therapeutic utility of the antibodies described herein can be further enhanced by modulating their functional characteristics, such as antibody-dependent cell-mediated cytotoxicity (ADCC), complement-dependent cytotoxicity (CDC), antibody dependent cellular phagocytosis (ADCP), serum half-life, biodistribution and binding to Fc receptors or the combination of any of these. This modulation can be achieved by protein-engineering, glyco-engineering or chemical methods. Depending on the therapeutic application required, it could be advantageous to either increase or decrease any of these activities.

An example of glyco-engineering uses the Potelligent® method as described in Shinkawa T. et al., 2003 (J Biol Chem 278: 3466-73).

Numerous methods for affinity maturation of antibodies are known in the art. Many of these are based on the general strategy of generating panels or libraries of variant proteins by mutagenesis followed by selection and/or screening for improved affinity. Mutagenesis is often performed at the DNA level, for example by error prone PCR (Thie, Voedisch et al. 2009, Methods Mol Biol 525: 309-322), by gene shuffling (Kolkman and Stemmer 2001, Nat Biotechnol. May; 19(5):423-8), by use of mutagenic chemicals or irradiation, by use of 'mutator' strains with error prone replication machinery (Greener 1996, In Vitro Mutagenesis Protocols. Humana press, NJ) or by somatic hypermutation approaches that harness natural affinity maturation machinery (Peled, Kuang et al. 2008, Annu Rev Immunol. 26:481-511). Mutagenesis can also be performed at the RNA level, for example by use of Qβ replicase (Kopsidas, Roberts et al. 2006, Immunol Lett. 2006 Nov. 15; 107(2):163-8). Library-based methods allowing screening for improved variant proteins can be based on various display technologies such as phage, yeast, ribosome, bacterial or mammalian cells, and are well known in the art (Benhar 2007, Expert Opin Biol Ther. May; 7(5): 763-79). Affinity maturation can be achieved by more directed/predictive methods for example by site-directed mutagenesis or gene synthesis guided by findings from 3D protein modeling (see for example Queen, Schneider et al. 1989, PNAS, 86(24): 10029-33 or U.S. Pat. No. 6,180,370 or 5,225,539).

Methods of increasing ADCC have been described by Ferrara, Brunker et al. 2006, Biotechnol Bioeng; 93:851-61; Li, Sethuraman et al. 2006, Nat Biotechnol; 24:210-5; Stavenhagen, Gorlatov et al. 2007, Cancer Res; 67:8882-90; Shields, Namenuk et al. 2001, J Biol Chem; 276:6591-604; Shinkawa, Nakamura et al. 2003, J Biol Chem; 278:3466-73; and WO 2008/006554.

Mutations may also be made in the Fc region that enhance binding to FcγRIIa which enhance macrophage phagocytosis of tumor cells. These include S239D, I332E and G236A. (Richards, J. et al. 2008 Mol. Canc. Ther. Vol. 8, pp: 2517.)

Methods of increasing CDC have been described by Idusogie, Wong et al. 2001, J Immunol; 176:346-56; Dall'Acqua, Cook et al. 2006, J Biol Chem; 281:23514-24; Michaelsen, Aase et al. 1990, Scand J Immunol; 32:517-28; Brekke, Bremnes et al. 1993, Mol Immunol; 30:1419-25; Tan, Shopes et al. 1990, PNAS; 87:162-6; and Norderhaug, Brekke et al. 1991, Eur J Immunol; 21:2379-84.

Methods of increasing ADCP have been described in Braster, O'Toole et al. 2014, Methods; 65:28-37, Gul & Egmond, 2015, Cancer Res; 75:5008-5013.

References describing methods of increasing ADCC and CDC include Natsume, In et al. 2008, Cancer Res; 68:3863-72. The disclosure of each of these references is included herein by cross reference.

A number of methods for modulating antibody serum half-life and biodistribution are based on modifying the interaction between antibody and the neonatal Fc receptor (FcRn), a receptor with a key role in protecting IgG from catabolism, and maintaining high serum antibody concentration. Dall'Acqua et al describe substitutions in the Fc region of IgG1 that enhance binding affinity to FcRn, thereby increasing serum half-life (Dall'Acqua, Woods et al. 2002, J Immunol; 169:5171-80) and further demonstrate enhanced bioavailability and modulation of ADCC activity with triple substitution of M252Y/S254T/T256E (with residue numbering according to the EU Index) or M265Y/S267T/T269 (with residue numbering according to the Kabat numbering system) (Dall'Acqua, Kiener et al. 2006, J Biol Chem; 279:6213-6). See also U.S. Pat. Nos. 6,277,375; 6,821,505; and 7,083,784. Hinton et al have described constant domain amino acid substitutions at positions 250 and 428 that confer increased in vivo half-life (Hinton, Johlfs et al. 2004, J Biol Chem; 279:6213-6; Hinton, Xiong et al. 2006, J Immunol; 176:346-56). See also U.S. Pat. No. 7,217,797. Petkova et al have described constant domain amino acid substitutions at positions 307, 380 and 434 that confer increased in vivo half-life (Petkova, Akilesh et al. 2006, Int Immunol; 18:1759-69). See also Shields et al 2001, J Biol Chem; 276:6591-604 and WO 2000/42072. Other examples of constant domain amino acid substitutions which modulate binding to Fc receptors and subsequent function mediated by these receptors, including FcRn binding and serum half-life, are described in U.S. Pat. Application Nos 20090142340; 20090068175 and 20090092599. The substitution referred to herein as "S228P" which is numbered according to the EU index as in Kabat has also been referred to as "S241P" according to Kabat et al. (1987 Sequences of proteins of immunological interest. United States Department of Health and Human Services, Washington D.C.). This substitution stabilizes the hinge region of IgG4 molecules, having the effect of making the sequence of the core of the hinge region the same as that of an IgG1 or IgG2 isotype antibody. This results in a reduction in the spontaneous dissociation and re-association of the heavy chains which often leads to the production of heterodimeric IgG4 antibodies.

The glycans linked to antibody molecules are known to influence interactions of antibody with Fc receptors and glycan receptors and thereby influence antibody activity, including serum half-life (Kaneko, Nimmerjahn et al. 2006, Science; 313:670-3; Jones, Papac et al. 2007, Glycobiology; 17:529-40; and Kanda, Yamada et al. 2007, Glycobiology; 17:104-18). Hence, certain glycoforms that modulate desired antibody activities can confer therapeutic advantage. Methods for generating engineered glycoforms are known in the art and include but are not limited to those described in U.S. Pat. Nos. 6,602,684; 7,326,681; 7,388,081 and in WO 2008/006554.

Extension of half-life by addition of polyethylene glycol (PEG) has been widely used to extend the serum half-life of proteins, as reviewed, for example, by Fishburn 2008, J Pharm Sci; 97:4167-83.

As will be recognised it is possible to make conservative amino acid substitutions within the sequences of the current invention. By "conservative substitution" is meant amino acids having similar properties. As used in this specification the following groups of amino acids are to be seen as conservative substitutions: H, R and K; D, E, N and Q; V, I and L; C and M; S, T, P, A and G; and F, Y and W. It is not intended, however, that substitutions other than those specifically recited are made at the sites of attenuation and/or glycosylation.

The term "cell surface-associated antigen", as used herein, broadly refers to any antigen expressed on surfaces of cells, including without limitation malignant cells or infectious or foreign cells.

The combination of the present invention comprises a CD47 antagonist. The CD 47 antagonist represses the binding of CD47 to SIRPα. There are a number of molecules which are known to antagonise the binding of CD47 to SIRPα. A number of these molecules are disclosed in the following references which are included herein by cross reference:

U.S. Pat. Nos. 7,282,556, 8,101,719, 8,562,997, 8,758,750, 9,017,675, 9,045,541, 9,221,908, US 2012/0189625, US 2012/0282174, US 2014/0140989, US 2014/0161805, US 2014/0199308, US 2015/0274826, US 2015/0329616, US 2015/0353642, US 2016/0008429, US 2016/0009814, and US 2016/0009815, It is preferred in some embodiments that the CD47 antagonist is an antibody, preferably a monoclonal antibody. In some embodiments the anti-CD47 antibody lacks effector function.

There are various ways known in the art to remove effector function. One is replacement of the N-linked glycosylation site on residue N297 to another residue, such as alanine (as shown in the examples and designated "non-glycosylated"). Other methods include making an antibody (which includes N297) in a cellular host that does not glycosylate N297 (e.g. in *E. coli*). Another way is to use an antigen-binding antibody fragment (Fab, Fab'2, scFv, Fv, etc) in which relevant effector function portions of the Fc are removed. Another way is to remove the glycosylation on residue N297 with a glycosidase such as PNGase F. Other ways of removing effector function are inclusion of one or more of various known Fc mutations that obliterate binding to various Fcγ receptors.

In certain embodiments the antibody comprises a heavy chain of SEQ ID NO:510 or 534 and a light chain of SEQ ID NO:509. As described above, in some particular embodiments the anti-CD47 antibody is non-glycosylated. An exemplary non-glycosylated antibody sequence is shown in SEQ ID NOS: 509 and 534.

In certain aspects of the present invention, the combination or compositions of the present invention is used to treat patients with cancer. Cancers contemplated herein include: a group of diseases and disorders that are characterized by uncontrolled cellular growth (e.g. formation of tumor) without any differentiation of those cells into specialized and different cells. Such diseases and disorders include ABL1 protooncogene, AIDS related cancers, acoustic neuroma, acute lymphocytic leukaemia, acute myeloid leukaemia, adenocystic carcinoma, adrenocortical cancer, agnogenic myeloid metaplasia, alopecia, alveolar soft-part sarcoma, anal cancer, angiosarcoma, aplastic anaemia, astrocytoma, ataxia-telangiectasia, basal cell carcinoma (skin), bladder cancer, bone cancers, bowel cancer, brain stem glioma, brain and CNS tumors, breast cancer, carcinoid tumors, cervical cancer, childhood brain tumors, childhood cancer, childhood leukaemia, childhood soft tissue sarcoma, chondrosarcoma, choriocarcinoma, chronic lymphocytic leukaemia, chronic myeloid leukaemia, colorectal cancers, cutaneous T-Cell lymphoma, dermatofibrosarcoma-protuberans, desmoplastic-small-round-cell-tumor, ductal carcinoma, endocrine cancers, endometrial cancer, ependymoma, esophageal cancer, Ewing's sarcoma, extra-hepatic bile duct cancer, eye cancer, eye: melanoma, retinoblastoma, fallopian tube cancer, fanconi anemia, fibrosarcoma, gall bladder cancer, gastric cancer, gastrointestinal cancers, gastrointestinal-carcinoid-tumor, genitourinary cancers, germ cell tumors, gestational-trophoblastic-disease, glioma, gynaecological cancers, hematological malignancies, hairy cell leukaemia, head and neck cancer, hepatocellular cancer, hereditary breast cancer, histiocytosis, Hodgkin's disease, human papillomavirus, hydatidiform mole, hypercalcemia, hypopharynx cancer, intraocular melanoma, islet cell cancer, Kaposi's sarcoma, kidney cancer, Langerhan's-cell-histiocytosis, laryngeal cancer, leiomyosarcoma, leukemia, Li-Fraumeni syndrome, lip cancer, liposarcoma, liver cancer, lung cancer, lymphedema, lymphoma, Hodgkin's lymphoma, non-Hodgkin's lymphoma, male breast cancer, malignant-rhabdoid-tumor-of-kidney, medulloblastoma, melanoma, merkel cell cancer, mesothelioma, metastatic cancer, mouth cancer, multiple endocrine neoplasia, mycosis fungoides, myelodysplastic syndromes, multiple myeloma, myeloproliferative disorders, nasal cancer, nasopharyngeal cancer, nephroblastoma, neuroblastoma, neurofibromatosis, nijmegen breakage syndrome, non-melanoma skin cancer, non-small-cell-lung-cancer-(NSCLC), ocular cancers, oesophageal cancer, oral cavity cancer, oropharynx cancer, osteosarcoma, ostomy ovarian cancer, pancreas cancer, paranasal cancer, parathyroid cancer, parotid gland cancer, penile cancer, peripheral-neuroectodermal-tumors, pituitary cancer, polycythemia vera, prostate cancer, rare-cancers-and-associated-disorders, renal cell carcinoma, retinoblastoma, rhabdomyosarcoma, Rothmund-Thomson syndrome, salivary gland cancer, sarcoma, schwannoma, Sezary syndrome, skin cancer, small cell lung cancer (SCLC), small intestine cancer, soft tissue sarcoma, spinal cord tumors, squamous-cell-carcinoma-(skin), stomach cancer, synovial sarcoma, testicular cancer, thymus cancer, thyroid cancer, transitional-cell-cancer-(bladder), transitional-cell-cancer-(renal-pelvis-/-ureter), trophoblastic cancer, urethral cancer, urinary system cancer, uroplakins, uterine sarcoma, uterus cancer, vaginal cancer, vulva cancer, Waldenstrom's-macroglobulinemia and Wilms' tumor. In an embodiment the tumor is selected from a group of multiple myeloma or non-hodgkin's lymphoma.

As contemplated for the treatment of cancer, the antibody portions of the polypeptide constructs of the combination of the present invention may bind to tumour-associated antigens, i.e., cell surface antigens that are selectively expressed by cancer cells or over-expressed in cancer cells relative to most normal cells. There are many tumour-associated antigens (TAAs) known in the art. Non-limiting examples of TAAs include enzyme tyrosinase; melanoma antigen GM2; alphafetoprotein (AFP); carcinoembryonic antigen (CEA); Mucin 1 (MUC1); Human epidermal growth factor receptor (Her2/Neu); T-cell leukemia/lymphoma 1 (TCL1) oncoprotein. Exemplary TAAs associated with a number of different cancers are telomerase (hTERT); prostate-specific membrane antigen (PSMA); urokinase plasminogen activator and its receptor (uPA/uPAR); vascular endothelial growth factor and its receptor (VEGF/VEGFR); extracellular matrix metalloproteinase inducer (EMMPRIN/CD147); epidermal growth factor (EGFR); platelet-derived growth factor and its receptor (PDGF/PDGFR) and c-kit (CD117).

A list of other TAAs is provided in US 2010/0297076, the disclosure of which is included herein by reference. Of particular interest are cell surface antigens associated with multiple myeloma leukemia or lymphoma cells, including but not limited to CD38, CD138, CD79, CS1, and HM1.24.

In one embodiment an antigen for ligand-attenuated IFN constructs, for example, an antibody-attenuated interferon construct, is CD38.

CD38 is a 46 kDa type II transmembrane glycoprotein. It has a short N-terminal cytoplasmic tail of 20 amino acids, a single transmembrane helix and a long extracellular domain of 256 amino acids (Bergsagel, P., Blood; 85:436, 1995 and Liu, Q., Structure, 13:1331, 2005). It is expressed on the surface of many immune cells including CD4 and CD8 positive T cells, B cells, NK cells, monocytes, plasma cells and on a significant proportion of normal bone marrow precursor cells (Malavasi, F., Hum. Immunol. 9:9, 1984). In lymphocytes, however, the expression appears to be dependent on the differentiation and activation state of the cell. Resting T and B cells are negative while immature and activated lymphocytes are predominantly positive for CD38 expression (Funaro, A., J. Immunol. 145:2390, 1990). Additional studies indicate mRNA expression in non-hemopoeitic organs such as pancreas, brain, spleen and liver (Koguma, T., Biochim. Biophys. Acta 1223:160, 1994.)

CD38 is a multifunctional ectoenzyme that is involved in transmembrane signaling and cell adhesion. It is also known as cyclic ADP ribose hydrolase because it can transform $NAD^+$ and $NADP^+$ into cADPR, ADPR and NAADP, depending on extracellular pH. These products induce $Ca^{2+}$-mobilization inside the cell which can lead to tyrosine phosphorylation and activation of the cell. CD38 is also a receptor that can interact with a ligand, CD31. Activation of receptor via CD31 leads to intracellular events including $Ca^{2+}$ mobilization, cell activation, proliferation, differentiation and migration (reviewed in Deaglio, S., Trends in Mol. Med. 14:210, 2008.)

CD38 is expressed at high levels on multiple myeloma cells, in most cases of T- and B-lineage acute lymphoblastic leukemias, some acute myelocytic leukemias, follicular center cell lymphomas and T lymphoblastic lymphomas. (Malavasi, F., J. Clin Lab Res. 22:73, 1992). More recently, CD38 expression has become a reliable prognostic marker in B-lineage chronic lymphoblastic leukemia (B-CLL) (Ibrahim, S., Blood. 98:181, 2001 and Durig, J., Leuk. Res. 25:927, 2002). Independent groups have demonstrated that B-CLL patients presenting with a $CD38^+$ clone are characterized by an unfavorable clinical course with a more advance stage of disease, poor responsiveness to chemotherapy and shorter survival time (Morabito, F., Haematologica. 87:217, 2002). The consistent and enhanced expression of CD38 on lymphoid tumors makes this an attractive target for therapeutic antibody technologies.

Examples of antibodies targeting CD38 are provided in U.S. Pat. No. 7,829,672, US2009/0123950, US2009/0304710, WO 2012/092612, WO 2014/178820, and US2002/0164788. The disclosure of each these references is included herein by cross-reference. The present extends to the use of the anti-CD38 antibodies disclosed in these references, with or without an attenuated polypeptide signalling ligand, together with a CD47 antagonist in the treatment of tumors in a subject. Of particular interest are the range of anti-CD38 antibodies disclosed in WO 2014/178820.

Antigens other than CD38 are well known in the art and non-protein examples of such antigens include, sphingolipids, ganglioside GD2 (Saleh et al., 1993, J. Immunol., 151, 3390-3398), ganglioside GD3 (Shitara et al., 1993, Cancer Immunol. Immunother. 36:373-380), ganglioside GM2 (Livingston et al., 1994, J. Clin. Oncol. 12:1036-1044), ganglioside GM3 (Hoon et al., 1993, Cancer Res. 53:5244-5250) and $Lewis^x$, $lewis^y$ and $lewis^{xy}$ carbohydrate antigens that can be displayed on proteins or glycolipids. Examples of protein antigens are HER-2/neu, human papillomavirus-E6 or -E7, MUC-1; KS 1/4 pan-carcinoma antigen (Perez and Walker, 1990, J. Immunol. 142:3662-3667; Bumal, 1988, Hybridoma 7(4):407-415); ovarian carcinoma antigen CA125 (Yu et al., 1991, Cancer Res. 51(2):468-475); prostatic acid phosphate (Tailor et al., 1990, Nucl. Acids Res. 18(16):4928); prostate specific antigen (Henttu and Vihko, 1989, Biochem. Biophys. Res. Comm. 160(2):903-910; Israeli et al., 1993, Cancer Res. 53:227-230); melanoma-associated antigen gp97 (Estin et al., 1989, J. Natl. Cancer Instit. 81(6):445-446); melanoma antigen gp75 (Vijayasar-dahl et al., 1990, J. Exp. Med. 171(4):1375-1380); prostate specific membrane antigen; carcinoembryonic antigen (CEA) (Foon et al., 1994, Proc. Am. Soc. Clin. Oncol. 13:294), MUC16 (antibodies include MJ-170, MJ-171, MJ-172 and MJ-173 [U.S. Pat. No. 7,202,346], 3A5 [U.S. Pat. No. 7,723,485]).NMB (U.S. Pat. No. 8,039,593), malignant human lymphocyte antigen-APO-1 (Bernhard et al., 1989, Science 245:301-304); high molecular weight melanoma antigen (HMW-MAA) (Natali et al., 1987, Cancer 59:55-63; Mittelman et al., 1990, J. Clin. Invest. 86:2136-2144); Burkitt's lymphoma antigen-38.13; CD19 (Ghetie et al., 1994, Blood 83:1329-1336); human B-lymphoma antigen-CD20 (Reff et al., 1994, Blood 83:435-445); GICA 19-9 (Herlyn et al., 1982, J. Clin. Immunol. 2:135); CTA-1 and LEA; CD33 (Sgouros et al., 1993, J. Nucl. Med. 34:422-430); oncofetal antigens such as alpha-fetoprotein for liver cancer or bladder tumor oncofetal antigen (Hellstrom et al., 1985, Cancer. Res. 45:2210-2188); differentiation antigens such as human lung carcinoma antigen L6 or L20 (Hellstrom et al., 1986, Cancer Res. 46:3917-3923); antigens of fibrosarcoma; human leukemia T cell antigen-Gp37 (Bhattacha-rya-Chatterjee et al., 1988, J. Immunol. 141:1398-1403); tumor-specific transplantation type of cell-surface antigen (TSTA) such as virally-induced tumor antigens including T-antigen, DNA tumor virus and envelope antigens of RNA tumor viruses; neoglycoproteins, breast cancer antigens such as EGFR (Epidermal growth factor receptor), polymorphic epithelial mucin (PEM) (Hilkens et al., 1992, Trends in Bio. Chem. Sci. 17:359); polymorphic epithelial mucin antigen; human milk fat globule antigen; colorectal tumor-associated antigens such as TAG-72 (Yokata et al., 1992, Cancer Res. 52:3402-3408), CO 17-1A (Ragnhammar et al., 1993, Int. J. Cancer 53:751-758); differentiation antigens (Feizi, 1985, Nature 314:53-57) such as I(Ma) found in gastric adenocarcinomas, SSEA-1 found in myeloid cells, VEP8, VEP9, Myl, VIM-D5, M18 and M39 found in breast epithelial cancers, $D_{156-22}$ found in colorectal cancer, TRA-1-85 (blood group H), C14 found in colonic adenocarcinoma, F3 found in lung adenocarcinoma, AH6 found in gastric cancer, Y hapten found in embryonal carcinoma cells, TL5 (blood group A), E1 series (blood group B) antigens found in pancreatic cancer, FC10.2 found in embryonal carcinoma cells, gastric adenocarcinoma antigen, CO-514 (blood group $Le^a$) found in adenocarcinoma, NS-10 found in adenocarcinomas, CO-43 (blood group $Le^b$), G49 found in A431 cells, 19.9 found in colon cancer; gastric cancer mucins; $R_{24}$ found in melanoma, MH2 (blood group $ALe^b/Le^y$) found in colonic adenocarcinoma, 4.2, D1.1, OFA-1, $G_{M2}$, OFA-2 and M1:22:25:8 found in embryonal carcinoma cells and SSEA-3 and SSEA-4. HMW-MAA (SEQ ID NO:390), also known as melanoma chondroitin sulfate proteoglycan, is a membrane-bound protein of 2322 residues which is over-expressed on over 90% of the surgically removed benign nevi and melanoma lesions (Camploi, et. al, Crit Rev Immunol.; 24:267, 2004). Accordingly it may be a potential target cell surface associated antigen.

Other example cancer antigens for targeting with fusion protein constructs of the combination of the present invention include (exemplary cancers are shown in parentheses): CD5 (T-cell leukemia/lymphoma), CA15-3 (carcinomas), CA19-9 (carcinomas), L6 (carcinomas), CA 242 (colorectal), placental alkaline phosphatase (carcinomas), prostatic acid phosphatase (prostate), MAGE-1 (carcinomas), MAGE-2 (carcinomas), MAGE-3 (carcinomas), MAGE-4 (carcinomas), transferrin receptor (carcinomas), p97 (melanoma), MUC1 (breast cancer), MART1 (melanoma), CD20 (non Hodgkin's lymphoma), CD52 (leukemia), CD33 (leukemia), human chorionic gonadotropin (carcinoma), CD38 (multiple myeloma), CD21 (B-cell lymphoma), CD22 (lymphoma), CD25 (B-cell Lymphoma), CD37 (B-cell lymphoma), CD45 (acute myeloblastic leukemia), HLA-DR (B-cell lymphoma), IL-2 receptor (T-cell leukemia and lymphomas), CD40 (lymphoma), CD79 (B cell leukemia or lymphoma, Hodgkin lymphoma), various mucins (carcinomas), P21 (carcinomas), MPG (melanoma), Ep-CAM (Epithelial Tumors), Folate-receptor alpha (Ovarian), A33 (Colorectal), G250 (renal), Ferritin (Hodgkin lymphoma), de2-7 EGFR (glioblastoma, breast, and lung), Fibroblast activation protein (epithelial) and tenascin metalloproteinases (glioblastoma). Some specific, useful antibodies include, but are not limited to, BR64 (Trail et al., 1997, Cancer Research 57:100 105), BR96 mAb (Trail et al., 1993, Science 261: 212-215), mAbs against the CD40 antigen, such as S2C6 mAb (Francisco et al., 2000, Cancer Res. 60:3225-3231) or other anti-CD40 antibodies, such as those disclosed in U.S. Patent Publication Nos. 2003-0211100 and 2002-0142358; mAbs against the CD30 antigen, such as AC10 (Bowen et al., 1993, J. Immunol. 151:5896-5906; Wahl et al., 2002 Cancer Res. 62(13):3736-42) or MDX-0060 (U.S. Patent Publication No. 2004-0006215) and mAbs against the CD70 antigen, such as 1F6 mAb and 2F2 mAb (see, e.g., U.S. Patent Publication No. 2006-0083736) or antibodies 2H5, 10B4, 8B5, 18E7, 69A7 (U.S. Pat. No. 8,124,738). Other antibodies have been reviewed elsewhere (Franke et al., 2000, Cancer Biother. Radiopharm. 15:459 76; Murray, 2000, Semin. Oncol. 27:64 70; Breitling, F., and Dubel, S., Recombinant Antibodies, John Wiley, and Sons, New York, 1998).

In certain embodiments, useful antibodies can bind to a receptor or a complex of receptors expressed on a target cell. The receptor or receptor complex can comprise an immunoglobulin gene superfamily member, a major histocompatibility protein, a cytokine receptor, a TNF receptor superfamily member, a chemokine receptor, an integrin, a lectin, a complement control protein, a growth factor receptor, a hormone receptor or a neuro-transmitter receptor. Non-limiting examples of appropriate immunoglobulin superfamily members are CD2, CD3, CD4, CD8, CD19, CD22, CD79, CD90, CD152/CTLA-4, PD-1, B7-H4, B7-H3, and ICOS. Non-limiting examples of suitable TNF receptor superfamily members are TACI, BCMA, CD27, CD40, CD95/Fas, CD134/OX40, CD137/4-1BB, TNFR1, TNFR2, RANK, osteoprotegerin, APO 3, Apo2/TRAIL R1, TRAIL R2, TRAIL R3, and TRAIL R4. Non-limiting examples of suitable integrins are CD11a, CD11b, CD11c, CD18, CD29, CD41, CD49a, CD49b, CD49c, CD49d, CD49e, CD49f, CD103 and CD104. Non-limiting examples of suitable lectins are S type, C type, and I type lectin. Examples of antibodies to CEA are shown in Table 1.

TABLE 1

CEA Antibodies

| Ab Clones | Patent | Assignee | Comments |
|---|---|---|---|
| COL-1 | U.S. Pat. No. 6,417,337 | The Dow Chemical Company | Humanized |
| 806.077 | U.S. Pat. No. 6,903,203 | AstraZeneca UK Ltd. | Humanized |
| T84.66 | U.S. Pat. No. 7,776,330 | City of Hope | Humanized |

Antibodies that bind the CD22 antigen expressed on human B cells include, for example, HD6, RFB4, UV22-2, To15, 4KB128 and a humanized anti-CD22 antibody (hLL2) (see, e.g., Li et al. (1989) Cell. Immunol. 111: 85-99; Mason et al. (1987) Blood 69: 836-40; Behr et al. (1999) Clin. Cancer Res. 5: 3304s-3314s; Bonardi et al. (1993) Cancer Res. 53: 3015-3021).

Antibodies to CD33 include, for example, HuM195 (see, e.g., Kossman et al. (1999) Clin. Cancer Res. 5: 2748-2755; U.S. Pat. No. 5,693,761) and CMA-676 (see, e.g., Sievers et al., (1999) Blood 93: 3678-3684).

Illustrative anti-MUC-1 antibodies include, but are not limited to Mc5 (see, e.g., Peterson et al. (1997) Cancer Res. 57: 1103-1108; Ozzello et al. (1993) Breast Cancer Res. Treat. 25: 265-276), and hCTMO1 (see, e.g., Van Hof et al. (1996) Cancer Res. 56: 5179-5185).

Illustrative anti-TAG-72 antibodies include, but are not limited to CC49 (see, e.g., Pavlinkova et al. (1999) Clin. Cancer Res. 5: 2613-2619), B72.3 (see, e.g., Divgi et al. (1994) Nucl. Med. Biol. 21: 9-15), and those disclosed in U.S. Pat. No. 5,976,531.

Illustrative anti-HM1.24 antibodies include, but are not limited to a mouse monoclonal anti-HM1.24 and a humanized anti-HM1.24 IgG1 kappa antibody (see, e.g., Ono et al. (1999) Mol. Immuno. 36: 387-395).

In certain embodiments the targeting moiety comprises an anti-Her2 antibody. The erBB 2 gene, more commonly known as (Her-2/neu), is an oncogene encoding a transmembrane receptor. Several antibodies have been developed against Her-2/neu, and some of these are in clinical use. These include trastuzumab (e.g., HERCEPTIN™; Fornir et al. (1999) Oncology (Huntingt) 13: 647-58), TAB-250 (Rosenblum et al. (1999) Clin. Cancer Res. 5: 865-874), BACH-250 (Id.), TA1 (Maier et al. (1991) Cancer Res. 51: 5361-5369), and the mAbs described in U.S. Pat. Nos. 5,772,997; 5,770,195 (mAb 4D5; ATCC CRL 10463); and U.S. Pat. No. 5,677,171.

Other fully human anti-Her2/neu antibodies are well known to those of skill in the art. Such antibodies include, but are not limited to the C6 antibodies such as C6.5, DPL5, G98A, C6MH3-B1, B1D2, C6VLB, C6VLD, C6VLE, C6VLF, C6MH3-D7, C6MH3-D6, C6MH3-D5, C6MH3-D3, C6MH3-D2, C6MH3-D1, C6MH3-C4, C6MH3-C3, C6MH3-B9, C6MH3-B5, C6MH3-B48, C6MH3-B47, C6MH3-B46, C6MH3-B43, C6MH3-B41, C6MH3-B39, C6MH3-B34, C6MH3-B33, C6MH3-B31, C6MH3-B27, C6MH3-B25, C6MH3-B21, C6MH3-B20, C6MH3-B2, C6MH3-B16, C6MH3-B15, C6MH3-B11, C6MH3-B1, C6MH3-A3, C6MH3-A2, and C6ML3-9. These and other anti-HER2/neu antibodies are described in U.S. Pat. Nos. 6,512,097 and 5,977,322, in PCT Publication WO 97/00271, in Schier et al. (1996) J Mol Biol 255: 28-43, Schier et al. (1996) J Mol Biol 263: 551-567, and the like.

More generally, antibodies directed to various members of the epidermal growth factor receptor family are well suited for use as targeting antibodies or antigen binding portions thereof in the constructs of the present invention. Such antibodies include, but are not limited to anti-EGFR antibodies as described in U.S. Pat. Nos. 5,844,093 and 5,558,864, and in European Patent No. 706,799A. Other illustrative anti-EGFR family antibodies include, but are not limited to antibodies such as C6.5, C6ML3-9, C6MH3-B1, C6-B1D2, F5, HER3.A5, HER3.F4, HER3.H1, HER3.H3, HER3.E12, HER3.B12, EGFR.E12, EGFR.C10, EGFR.B11, EGFR.E8, HER4.B4, HER4.G4, HER4.F4, HER4.A8, HER4.B6, HER4.D4, HER4.D7, HER4.D11, HER4.D12, HER4.E3, HER4.E7, HER4.F8 and HER4.C7 and the like (see, e.g., U.S. Patent publications US 2006/0099205 A1 and US 2004/0071696 A1 which are incorporated herein by reference).

CD38 is of particular interest as an antibody target for fusion protein constructs of the present invention. Antibodies to CD38 include for example, Daratumumab, AT13/5 (see, e.g., Ellis et al. (1995) J. Immunol. 155: 925-937), HB7, antibodies disclosed in WO 2014/178820 (the disclosure of which is included herein by reference) and the like. The sequence of a preferred anti-CD38 antibody is provided as SEQ ID NOS 506 and 507.

The present invention also provides one or more compositions comprising the combination of the present invention. These compositions can further comprise at least one of any suitable auxiliary, such as, but not limited to, diluent, binder, stabiliser, buffers, salts, lipophilic solvents, preservative, adjuvant or the like. Pharmaceutically acceptable auxiliaries are preferred. Non-limiting examples of, and methods of preparing such sterile solutions are well known in the art, such as, but not limited to, Gennaro, Ed., Remington's Pharmaceutical Sciences, 18th Edition, Mack Publishing Co. (Easton, Pa.) 1990. Pharmaceutically acceptable carriers can be routinely selected that are suitable for the mode of administration, solubility and/or stability of the antibody composition as well known in the art or as described herein.

Pharmaceutical excipients and additives useful in the present composition include but are not limited to proteins, peptides, amino acids, lipids, and carbohydrates (e.g., sugars, including monosaccharides, di-, tri-, tetra-, and oligosaccharides; derivatised sugars such as alditols, aldonic acids, esterified sugars and the like; and polysaccharides or sugar polymers), which can be present singly or in combination, comprising alone or in combination 1-99.99% by weight or volume. Exemplary protein excipients include serum albumin, such as human serum albumin (HSA), recombinant human albumin (rHA), gelatin, casein, and the like. Representative amino acids which can also function in a buffering capacity include alanine, glycine, arginine, betaine, histidine, glutamic acid, aspartic acid, cysteine, lysine, leucine, isoleucine, valine, methionine, phenylalanine, aspartame, combinations thereof such as arginine-histidine buffers and the like. One preferred amino acid is histidine. A second preferred amino acid is arginine.

Carbohydrate excipients suitable for use in the invention include, for example, monosaccharides, such as fructose, maltose, galactose, glucose, D-mannose, sorbose, and the like; disaccharides, such as lactose, sucrose, trehalose, cellobiose, and the like; polysaccharides, such as raffinose, melezitose, maltodextrins, dextrans, starches, and the like; and alditols, such as mannitol, xylitol, maltitol, lactitol, xylitol sorbitol (glucitol), myoinositol and the like. Preferred carbohydrate excipients for use in the present invention are mannitol, trehalose, and raffinose.

Antibody compositions can also include a buffer or a pH adjusting agent; typically, the buffer is a salt prepared from an organic acid or base. Representative buffers include organic acid salts, such as salts of citric acid, ascorbic acid, gluconic acid, carbonic acid, tartaric acid, succinic acid, acetic acid, or phthalic acid; Tris, tromethamine hydrochloride, phosphate buffers or amino acid buffers. Preferred buffers for use in the present compositions are organic acid salts, such as citrate or amino acids.

Additionally, the compositions of the invention can include polymeric excipients/additives, such as polyvinylpyrrolidones, ficolls (a polymeric sugar), dextrates (e.g., cyclodextrins, such as 2-hydroxypropyl-β-cyclodextrin), polyethylene glycols, flavoring agents, antimicrobial agents, sweeteners, antioxidants, antistatic agents, surfactants (e.g., polysorbates such as "TWEEN® 20" and "TWEEN® 80"), lipids (e.g., phospholipids, fatty acids), steroids (e.g., cholesterol), and chelating agents (e.g., EDTA).

These and additional known pharmaceutical excipients and/or additives suitable for use in the antibody compositions according to the invention are known in the art, e.g., as listed in "Remington: The Science & Practice of Pharmacy", 19th ed., Williams & Williams, (1995), and in the "Physician's Desk Reference", 52nd ed., Medical Economics, Montvale, N.J. (1998), the disclosures of which are entirely incorporated herein by reference. Preferred carrier or excipient materials are carbohydrates (e.g., saccharides and alditols) and buffers (e.g., citrate) or polymeric agents.

Those skilled in the art will appreciate that the invention described herein is susceptible to variations and modifications other than those specifically described. It is to be understood that the invention includes all such variations and modifications which fall within the spirit and scope. The invention also includes all of the steps, features, compositions and compounds referred to or indicated in this specification, individually or collectively, and any and all combinations of any two or more of said steps or features.

Unless defined otherwise, all technical and scientific terms used herein have the same meanings as commonly understood by one of ordinary skill in the art to which this invention belongs. Although any materials and methods similar or equivalent to those described herein can be used to practice or test the present invention, the preferred materials and methods are now described.

EXAMPLES

Example 1

Robust and Durable Anti-Tumor Activity of CD38-Attenuated IFNα2b in Myeloma Xenograft Model NCI-H929 plasma cell myeloma cells were maintained as exponentially growing suspension cultures in standard growth media and conditions. The tumor cells used for implantation were harvested during log phase growth and resuspended at a concentration of $1 \times 10^8$ cells/mL in 50% Matrigel (BD Biosciences). $1 \times 10^7$ tumor cells (0.1 mL cell suspension) were implanted subcutaneously with into left flank of 8-9 week old female severe combined immunodeficient (SCID) mice. In this model the CD38+ myeloma tumor cells grow as a vascularized subcutaneous mass. Tumors were allowed to grow to an average volume of 150 mm$^3$ before treatment began. Tumors were measured with calipers in two dimensions to monitor size. Mice (10/cohort) were treated intraperitoneally, twice per week for 4 weeks with 5 mg/kg anti-CD38-attenuated IFNα2b fusion protein (SEQ ID NOS 507/508) or an isotype control fusion protein consisting of an irrelevant antibody fused to attenuated IFNα2b or vehicle at fixed volume of 0.2 mL. Tumor volumes were monitored. Mean (+/−SEM) tumor volumes are are presented in FIG. 1. The results indicated the robust anti-tumor activity of anti CD38-attenuated interferon α2b fusion protein in this model, with 10 out of 10 mice showing disappearance of tumors and no subsequent reappearance after treatment cessation (a "curative" response). Non of the animals treated with irrelevant antibody fused to attenuated IFNα2b or the vehicle control were cured.

Example 2

Macrophage Involvement in Anti CD38-Attenuated Interferon α2b Fusion Protein Activity in a Responsive Myeloma Model, H929

Figure 2A:
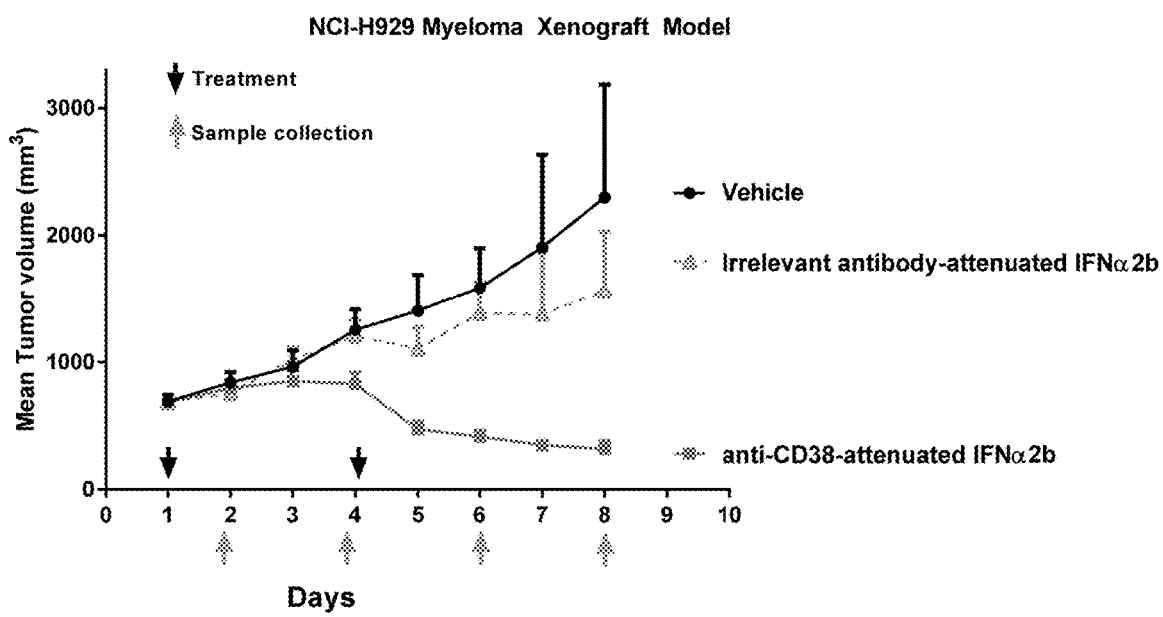
FIG. 2A: Graph of tumor volumes in an NCI-H929 myeloma xenograft model showing results of treatment with an anti-CD38-attenuated IFNα2b fusion protein compared to an isotype control-attenuated IFNα2b antibody. Black arrows indicate the time points of treatments, and grey arrows indicate the time points for sampling of tumors for histological analysis.

To analyse the mechanisms mediating the robust anti-tumor activity of anti CD38-attenuated IFNα2b (h10A2-hIgG4) fusion protein (SEQ ID NOS 507/508) illustrated in Example 1, tumors from treated vs untreated or control treated mice were excised and evaluated by immunohistochemistry. Cells were grown, prepared and implanted into mice as described in Example 1. Tumors were allowed to grow to an average volume of 600-750 mm$^3$ before treatment began. Mice (12/cohort) were treated intraperitoneally with PBS, 10 mg/kg anti CD38-attenuated IFNα2b fusion protein (SEQ ID NOS: 507/508) or an isotype control consisting of an irrelevant antibody fused to attenuated IFNα2b on days 1 and 4 (black arrows shown above x-axis in FIG. 2A). Tumor size was measured daily and mean (+/−SEM) tumor volumes were plotted in FIG. 2A. At selected time points (gray arrows) tumors were excised from 3 mice from each group and frozen for immunohistochemistry evaluation described below in detail. Cross sections of excised tumors (2 from each group) were mounted and stained with hematoxylin for tumor size comparison.

Immunohistochemistry analysis (FIG. 2B) was performed on excised tumor sections. Markers used were CD45 (rat anti-mouse CD45, abcam #ab25386, 5.0 μg/ml) for mouse leukocytes, F4/80 (rat anti-mouse F4/80, abcam #ab6640, 10.0 μg/ml) for mouse macrophages, a rat IgG2b isotype control (rat IgG2b, abcam #ab18531, 10 μg/ml), inducible nitric oxide synthetase (iNOS) (rabbit anti-mouse iNOS, novus #NBP1-33780, 1:1,000) as an M1 macrophage marker, and a rabbit IgG control (invitrogen #086199). Stained slides were examined under light microscopy, and quantification of CD45+, F4/80+, and iNOS+ infiltrate was performed.

CD45 and F4/80 staining showed very similar patterns in all tumors indicating that the CD45+ infiltrating cells largely consist of mouse macrophages. A comparison of ex vivo tumors from the three treatment groups indicated profuse macrophage infiltration into tumors of mice treated with anti CD38-attenuated IFNα2b fusion protein but not into control treated tumors (data now shown). The macrophage infiltration was observed at 24 hours following the start of treatment and peaked at day 5 in this model.

Figure 2B:
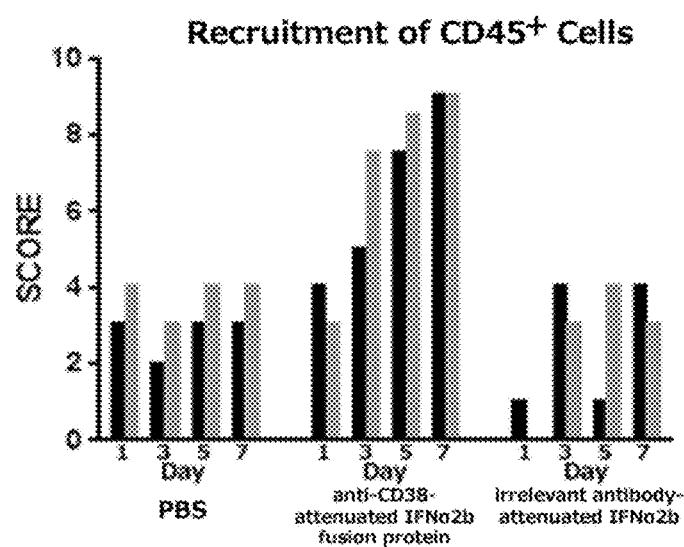
FIG. 2B: Graph of the scoring from histological analysis of tumor samples taken from the experiment shown in FIG. 2A. NCI-H929 myeloma xenografts treated with anti-CD38-attenuated IFNα2b fusion protein exhibited increased peripheral tumor CD45$^+$ cell recruitment over time compared to controls. Each bar is a representative of a single mouse. Two mice were tested at each timepoint.

The degree of macrophage infiltration and invasiveness was assessed visually and scored based on multiple criteria, including the percentage of the tumor circumference showing macrophage infiltration, the depth of macrophage penetration into the tumor from the tumor surface, and the degradation or loss of tumor cellular mass which was supplanted with macrophage infiltrate and stroma. A score of "0" indicated homogeneous scattered CD45+ (residential macrophage) infiltration throughout tumor mass and an intact and defined peripheral tumor border and capsule. A score of "10" indicated a high density of macrophage infiltration along the tumor margin, deep penetration of macrophages beyond the tumor periphery over more than 10% of the tumor diameter, a significant degradation of tumor cellular mass and a high proportion (>50%) of tumor mass supplanted with macrophages and/or stroma. Tumors in the anti CD38-attenuated IFNα2b fusion protein treated mice exhibited substantially higher scores at days 3, 5 and 7 than the vehicle or irrelevant antibody fused to attenuated IFNα2b control mice, as shown in FIG. 2B, suggesting that the anti CD38-attenuated IFNα2b fusion protein-mediated macrophage invasion which was associated with the destruction of the tumor. Each bar is a representative of a single mouse. iNOS immunohistochemistry of the tumor sections indicated that the infiltrating macrophages were primarily of the M1 macrophage subtype which is known to exhibit tumoricidal activity. This suggests that macrophage infiltration was involved in the robust anti-tumor efficacy observed with the anti CD38-attenuated IFNα2b fusion protein.

Example 3

Macrophage Involvement in Anti Human HLA-Attenuated Interferon α2b Fusion Protein Activity in a Non-Responsive Renal Cell Cancer Model, 786-0

Figure 3A:
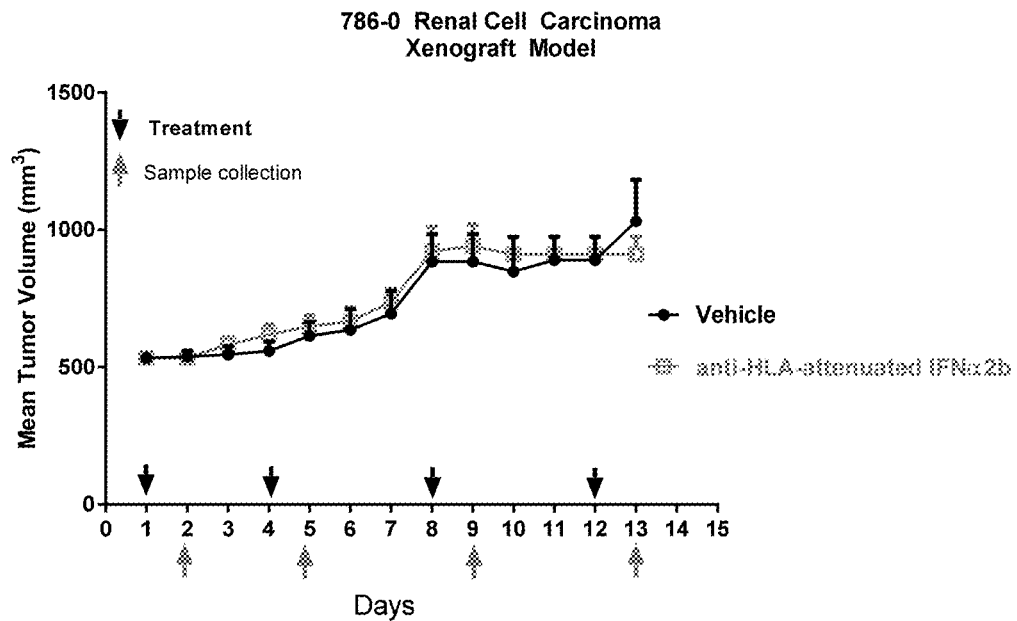
FIG. 3A: Graph of tumor volumes in a 786-0 renal carcinoma xenograft model showing results of treatment with an anti-HLA-attenuated IFNα2b fusion protein compared to vehicle administration. Black arrows indicate the time points of administration treatments, and grey arrows indicate the time points for sampling of tumors for histological analysis. Anti-HLA-attenuated IFNα2b fusion protein showed no effect on tumor inhibition in this model.
Figure 3B:
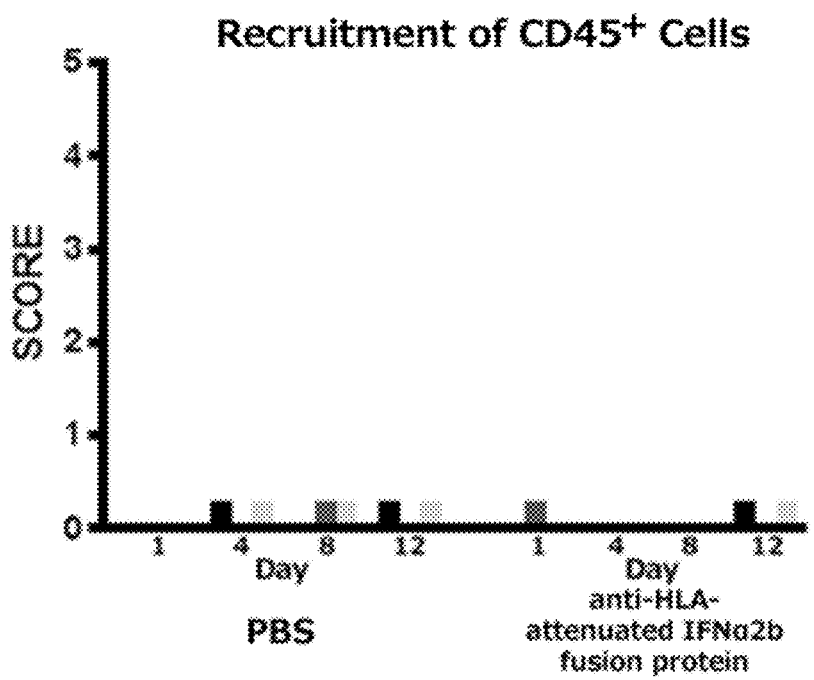
FIG. 3B: Graph of the scoring from histological analysis of tumor samples taken from the experiment shown in FIG. 3A. Recruitment of CD45$^+$ cells was much less pronounced in this model compared to the results obtained with anti-CD38-attenuated IFNα2b fusion protein in the NCI-H929 myeloma xenograft model (FIGS. 2A and 2B). Each bar represents a single mouse.

The role of macrophage infiltration in a non-responsive xenograft tumor model was investigated. This study was performed in a similar manner as the multiple myeloma xenograft model described in Example 1 and in Example 2. Ten million human HLA-expressing 786-0 renal cell carcinoma cells were implanted with matrigel into SCID mice and the tumors grown to an average volume of 500 mm$^3$. Mice were treated with PBS or 10 mg/kg of an anti-HLA-attenuated IFNα2b (HB95-IgG4) fusion protein (SEQ ID NOS: 521 and 522) at the time points indicated by black arrows in FIG. 3A. The anti-HLA antibody used in this fusion protein was human-specific and therefore bound to the human tumor cells but not to any murine cells. Tumors from three mice per group were excised at time points indicated by gray arrows. An immunohistochemistry analysis and quantitation of macrophage infiltration was performed as described above. As this model uses a non-responsive xenograft tumor, mice implanted with these human tumors treated with anti-HLA-attenuated IFNα2b fusion protein showed no anti-tumor response and no increased infiltration of macrophages, as illustrated in FIGS. 3A and 3B respectively. The lack of anti-tumor response and lack of macrophage infiltration is consistent with an association between the degree of macrophage infiltration and the degree of an anti-tumor response following exposure of the tumor to a targeted antibody-attenuated IFNα2b fusion protein.

Example 4

In Vivo Studies with Macrophage-Defective Mouse Strains Implicate a Requirement for Macrophages for Durable Anti-Tumor Responses Additional models using the NCI-H929 multiple myeloma cell line were examined to further evaluate the role of macrophage activity in robust anti-tumor responses. In these models, three strains of mice were used as hosts for the myeloma tumors, each strain possessing different immune system defects (summarized in Table 2). The SCID strain, while missing T- and B-cell components of the adaptive immune system, still have dendritic cells, macrophages, NK cells and complement. The NOD-SCID strain is defective in dendritic cells, macrophages and NK cells, and is missing a functional complement system. The NSG cell line is defective in dendritic cells and macrophages and is missing both NK cells and a functional complement.

TABLE 2

| | Mouse Strain: | | |
| Innate Immune Cells | SCID | NOD_SCID | NSG |
| --- | --- | --- | --- |
| Dendritic Cells | Present | Defective | Defective |
| Macrophages | Present | Defective | Defective |
| NK Cells | Present | Defective | Absent |
| Complement | Present | Absent | Absent |

Figure 4:
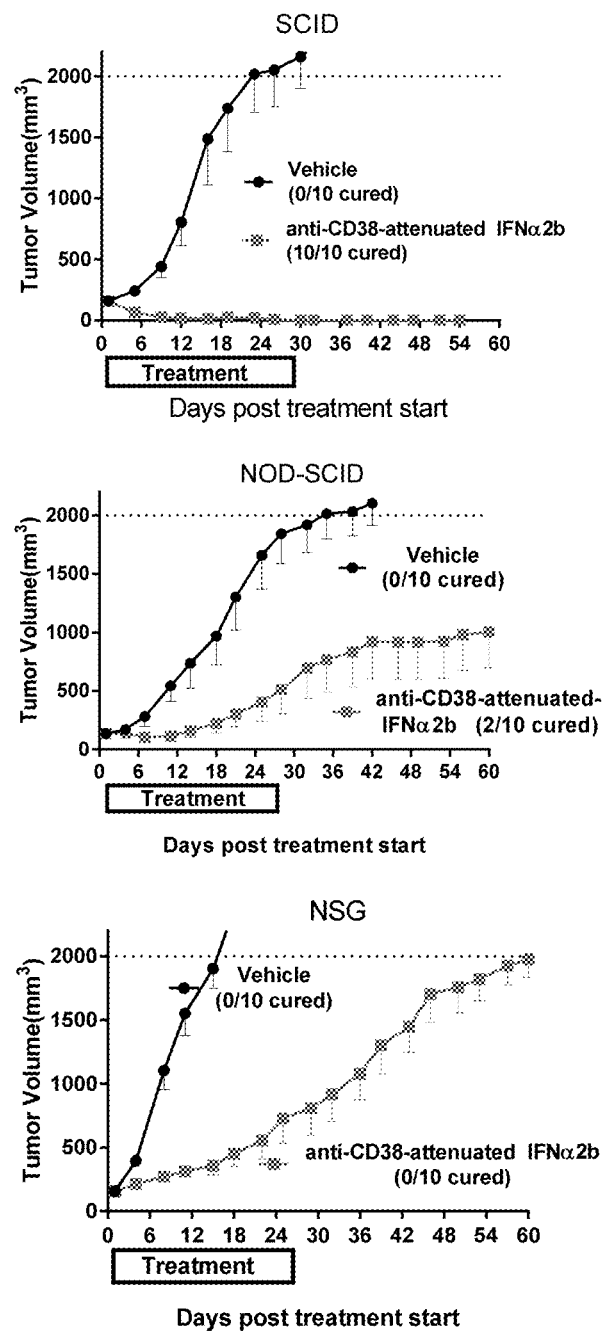
FIG. 4: Provides graphs with the results of experiments using these different immune-cell defective mouse strains in an NCI-H929 myeloma xenograft model. The graphs show NCI-H929 tumor volumes following treatment with anti-CD38-attenuated IFNα2b fusion protein compared to vehicle. Treatments resulted in 10 of 10 animals cured in the SCID mouse strain, 2 of 10 animals cured in the NOD-SCID strain, and 0 of 10 in the NSG strain.

In this study 10$^7$ CD38-expressing NCI-H929 cells were implanted subcutaneously into the left flank of each mouse. Tumors were allowed to grow to an average volume of 150 mm$^3$ before treatment began. Mice (10/cohort) were treated twice per week for four weeks with 5 mg/kg anti CD38-attenuated IFNα2b (h10A2-IgG4) fusion protein (SEQ ID NOS: 507/508) or vehicle. Tumor volumes were monitored daily and plotted in FIG. 4. While 10 of 10 mice were cured (no tumor regrowth seen after treatment ceased) in SCID mice, only 2 of 10 mice were cured in NOD-SCID and none of the NSC mice were cured.

While SCID mice with intact macrophages exhibited a robust curative response following the administration of anti CD38-attenuated IFNα2b fusion protein the NOD-SCID and NSG had defective monocytes/macrophages and exhibited substantially less robust responses, supporting the interpretation that macrophages and or dendritic cells were instrumental in mediating the robust, curative efficacy. The delayed, but not complete, response observed in mouse strains with defective macrophage compartments likely reflected direct anti-proliferative activity of the human IFNα on the tumor cells. This effect delayed tumor growth but rarely resulted in a complete curative response.

Example 5

Depletion of Macrophages In Vivo

To further explore whether functional macrophage activity was required for durable responses to a CD38 antibody-targeted attenuated Type I interferon fusion protein the CD38-expressing NCI-H929 xenograft model was performed in SCID mice which were chemically depleted of macrophages using clodronate liposomes.

Free clodronate does not easily pass phospholipid bilayers of liposomes or intact cell membranes but liposomes loaded with clodronate are phagocytosed by macrophages. Once clodronate is delivered into phagocytic macrophages using liposomes as a vehicle the phospholipid bilayers of the liposomes are disrupted under the influence of lysosomal phospholipases and the drug is released into the cell cytoplasm where it accumulates. After intracellular clondronate exceeds a threshold concentration, the cell is irreversibly damaged and dies by apoptosis (J. Immunol. Meth. 193: 93-99, 1996). Any free clodronate released from dead macrophages or lysed liposomes has an extremely short half life in the circulation as it is rapidly removed from the circulation by the renal system.

Figure 5:
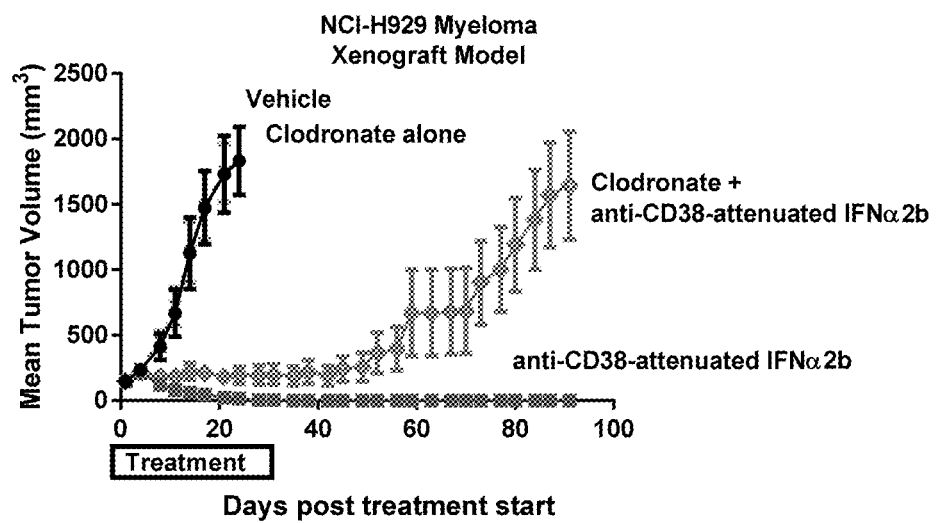
FIG. 5: Graph of tumor volumes in an NCI-H929 myeloma xenograft model showing results of treatment with an anti-CD38-attenuated IFNα2b fusion protein, or with an anti-CD38-attenuated IFNα2b fusion protein in liposomal clodronate pre-treated animals compared to vehicle or liposomal clodronate pre-treatment alone. The addition of the macrophage-killing agent liposomal clodronate substantially inhibited tumor destruction by the anti-CD38-attenuated IFNα2b fusion protein in this model.

NCI-H929 tumor cells were grown, prepared and implanted as described in Example 1. Tumors were allowed to grow to an average volume of 150 mm$^3$ before treatment began. Mice (10/cohort) were treated intravenously, twice per week for four weeks with 5 mg/kg anti-CD38-attenuated IFNα2b (h10a2-IgG4) fusion protein (SEQ ID NO:507 and SEQ ID NO:508) or vehicle, with or without accompanying liposomal clodronate treatment. Clodronate liposomes (purchased from Encapsula Nano Sciences LLC at 5 mg/mL suspension) were suspended and 0.1 mL administered i.v on days −2, 0, 1, 3, 6, 10 and 17 (relative to the commencement of administration of anti-CD38-attenuated IFNα2b). Tumor volumes were monitored twice a week regularly and mean (+/−SEM) tumor volumes plotted as shown in FIG. 5.

While all mice without liposomal clondronate treatment were cured following treatment with the anti-CD38-attenuated IFNα2b fusion protein, the administration of liposomal clondronate resulted in tumors continuing to grow, albeit at a delayed rate. Consistent with the previous findings, the depletion of macrophages using clodronate liposomes prevented complete tumor eradication (in 4/10 animals) indicating that macrophages are a critical component in the response which results in complete tumor elimination.

Example 6

In Vivo Evaluation of the Importance of FcGamma Receptor (FcγR) Binding:

Macrophages are able to kill tumor cells either through a variety of antibody dependant mechanisms such as Antibody Dependant Cellular Phagocytosis (ADCP) or Antibody Dependant Cell-mediated Cytotoxicity (ADCC), or through antibody independent mechanisms (Int. J. Cancer; 46, 682-686, 1990). To determine whether the macrophage-based killing of tumor cells that occurs with anti-CD38-attenuated IFNα2b fusion protein treatment was antibody dependent or independent, we utilized a modified anti-CD38-attenuated IFNα2b fusion protein bearing a N297A substitution, which removes the site of glycosylation in the human IgG4 Fc region of this fusion protein. Removal of this glyosylation site renders the immunoglobulin portion of the fusion protein unable to bind FcγRs on effector cells such as macrophages, and thus the Fc is unable to mediate ADCC or ADCP.

Figure 6:
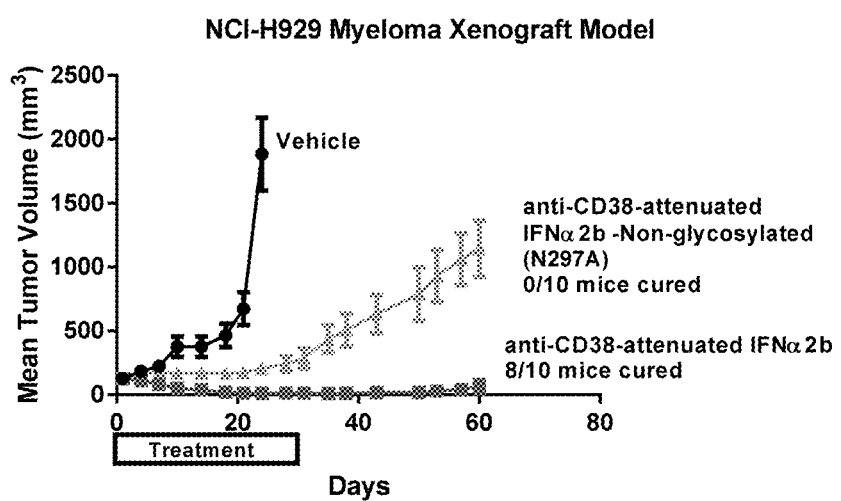
FIG. 6: Graph of tumor volumes in an NCI-H929 myeloma xenograft model showing results of treatment with an anti-CD38-attenuated IFNα2b fusion protein compared to a non-glycosylated anti-CD38-attenuated IFNα2b fusion protein in which the antibody Fc glycosylation site at N297 was removed by the substitution mutation N297A, compared to vehicle alone. Removal of the Fc glycosylation substantially reduced tumor destruction by the fusion protein in this model indicating the mechanism for tumor eradication likely includes a substantial contribution from antibody dependent cellular phagocytosis (ADCP).

In this study, NCI-H929 myeloma cells were grown, prepared and implanted as previously described in Example 1. When tumors reached 150 mm³, treatment began (twice per week for a total of four weeks). Groups were treated with either PBS or 5 mg/kg anti-CD38-attenuated IFNα2b (h10A2-IgG4) fusion protein (SEQ ID NOS: 507/508) or 5 mg/kg of the non-glycosylated variant of anti-CD38-attenuated IFNα2b (h10A2-IgG4) fusion protein (N297A) (SEQ ID NOS: 531 and 507). Tumor size was measured regularly and mean tumour volume was plotted in FIG. 6. The results indicated that activity of anti-CD38-attenuated IFNα2b fusion protein requires a functional FcγR interaction for robust, curative anti-tumor response. This implicates ADCP and/or ADCC in the mechanism of action of robust tumor clearance.

Example 7

Enhancement of Macrophage Activity

The CD47:SIRPα axis has been described to be involved in ADCP-mediated anti-tumor activity of macrophages. In order to assess the contribution of this axis in anti-tumor activity using an anti-CD38-attenuated IFNα2b (h10A2-IgG4) fusion protein, a commercially-available anti-human CD47-blocking antibody (B6H12.2 Bio X cell, BE0019-1) was administered during the treatment phase of efficacy models as reported by others (Liu, et al., 2015, Nature Medicine), as described below. In some examples the glycosylated commercial antibody (SEQ ID NOS 513/514) was used and in other examples a non-glycoylated variant (SEQ ID NOS 515/516) was used.

Hematological Malignancy Model: NCI-H92 Myeloma

Figure 7:
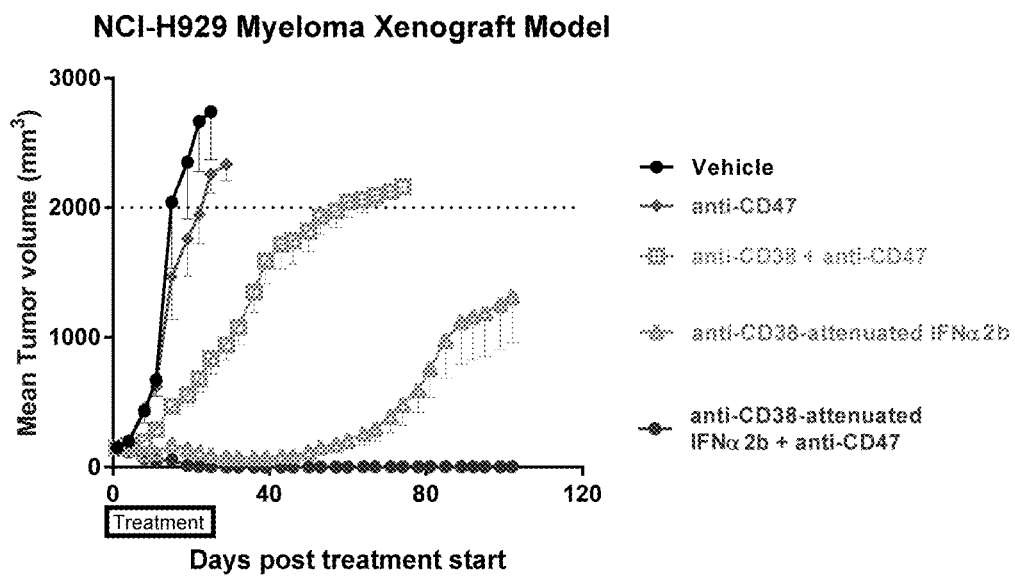
FIG. 7: Graph of tumor volumes showing results of treatment with anti-CD38-attenuated IFNα2b fusion protein alone (at a suboptimal dose), non-glycosylated anti-CD47 antibody alone, the combination of the two agents, or controls. Treatment with the combination of anti-CD38-attenuated IFNα2b fusion protein (suboptimal dose) with non-glycosylated anti-CD47 antibody completely eliminated NCI-H929 tumors in 10 of 10 mice, while the activity of anti-CD38-attenuated IFNα2b fusion protein alone at a suboptimal dose only moderately delayed tumor growth and was not curative.

The effectiveness of combination therapy of anti-CD38-attenuated IFNα2b fusion protein (at suboptimal dose) with non-glycosylated anti-CD47 antibody was evaluated in NCI-H929 myeloma xenograft model similar to that described in Example 1. Ten million H929 cells in 50% Matrigel were inoculated subcutaneously (s.c.) into the flank of 8-9 weeks old female SCID mice. Treatment was started when tumors reached an average size of 150 mm³. The mice (n=10 in each group) were treated intraperitoneally (i.p.) with either (a) vehicle (PBS) (b) 2 mg/kg anti-CD38-attenuated IFNα2b (h10A2-hIgG4) fusion protein (SEQ ID NOS: 507/508), (c) 5 mg/kg non-glycosylated (to eliminate the effector function) anti-CD47 (B6H12-mIgG1) antibody (SEQ ID NOS: 515/516), (d) 2 mg/kg anti-CD38-attenuated IFNα2b (h10A2-hIgG4) fusion protein plus 5 mg/kg non-glycosylated anti-CD47 (B6H12-mIgG1) antibody, or (e) 2 mg/kg anti-CD38 (h10A2-hIgG4) antibody plus 5 mg/kg non-glycosylated anti-CD47 (B6H12-mIgG1) antibody. All fusion proteins and the anti-CD38 antibody were administered twice weekly for four weeks. The non-glycosylated anti-CD47 (B6H12-mIgG1) antibody was administered every other day for 14 days. Tumor volumes were monitored. Mean (+/−SEM) tumor volumes are are presented in FIG. 7. In this study, the anti-CD38-attenuated IFNα2b (h10A2-hIgG4) fusion protein construct at suboptimal dose exhibited moderate tumor inhibition and was not curative, but when combined with CD47 blockade its robust anti tumor regression was restored and was curative (10/10 animals cured).

Hematological Malignancy Model: RPMI-8226 Myeloma

Figure 8:
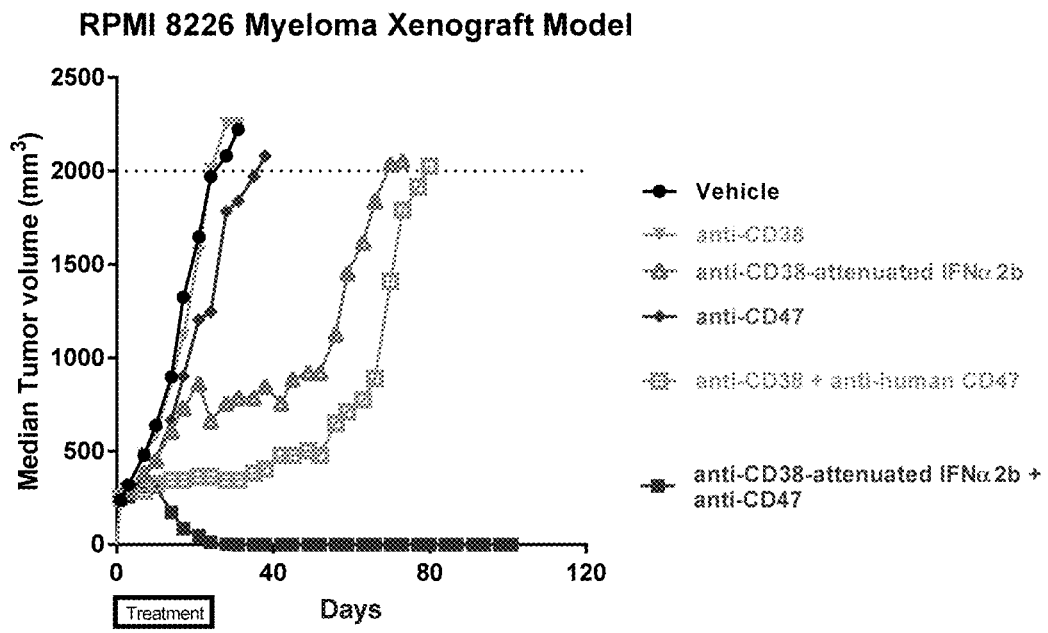
FIG. 8: Graph of tumor volumes in an RPMI 8226 multiple myeloma xenograft model showing results of treatment with an anti-CD38-attenuated IFNα2b fusion protein (at a suboptimal dose), with CD47 blockade using a non-glycosylated anti-CD47 antibody, or a combination of anti-CD38-attenuated IFNα2b fusion protein (suboptimal dose) and non-glycosylated anti-CD47 antibody, compared to vehicle or controls. In this model, the combination of anti-CD38-attenuated IFNα2b fusion protein and CD47 blockade by non-glycosylated anti-CD47 antibody was more effective in ablating tumors (8 of 10 animals cured) than treatment with individual agents or combination of control agents.

Ten million CD38-expressing RPMI-8226 cells were subcutaneously implanted into the flank of SCID mice. Treatment started when tumors reached an average size of 130-170 mm³. The mice were treated with i.p. injection of either (a) vehicle, (b) a suboptimal dose (3 mg/kg) of the anti-CD38-attenuated IFNα2b (h10A2-IgG4) fusion protein (SEQ ID NOS: 507/508) twice a week for four weeks, or (c) a 5 mg/kg of non-glycosylated anti-CD47 antibody (B6H12, IgG1) (SEQ ID NOS: 515/516) every other day for fourteen days; or (d) a regimen of 3 mg/kg anti-CD38 antibody (h10A2-IgG4) (SEQ ID NOS: 506/507) and non-glycosylated anti-CD47 antibody administered separately with the same dosing regime as individual agents or (e) 3 mg/kg anti-CD38-attenuated IFNα2b fusion protein and non-glycosylated anti-CD47 antibody administered separately with the same dosing regimen as individual agents. Tumor volumes (+/−SEM) were measured twice a week and mean tumor volumes were plotted as shown in FIG. 8.

The anti CD38-attenuated IFNα2b fusion protein therapy alone and the combination of anti-CD38 antibody with non-glycosylated anti-CD47 exerted moderate inhibition of tumor growth in the RPMI-8226 myeloma xenograft model; however no tumors were completely resolved with this combination of agents. Treatment with the non-glycosylated anti-CD47 antibody alone had no effect. The combination of an anti-CD47 antibody and an anti-CD38-attenuated IFNα2b (h10A2-IgG4) fusion protein induced a robust, synergistic response with 8/10 mice cured at the end of study.

Hematological Malignancy Model: OPM2 Myeloma

The CD38-expressing OPM2 myeloma cell line model of multiple myeloma was typically only weakly responsive to treatment with an anti-CD38-attenuated IFNα2b (h10A2-

Figure 9:
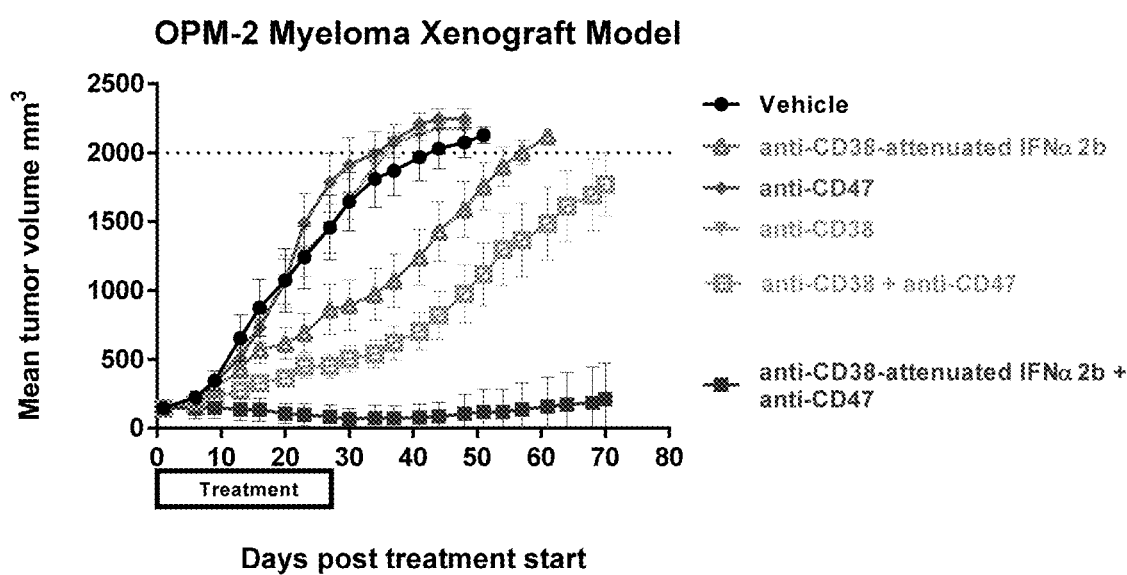
FIG. 9: Graph of tumor volumes in an OPM-2 myeloma xenograft model showing results of treatment with an anti-CD38-attenuated IFNα2b fusion protein, with CD47 blockade using a non-glycosylated anti-CD47 antibody, or a combination of anti-CD38-attenuated IFNα2b fusion protein and non-glycosylated anti-CD47 antibody, compared to vehicle or controls. In this model, the combination of anti-CD38-attenuated IFNα2b and CD47 blockade by non-glycosylated anti-CD47 antibody was more effective in ablating tumors (5 of 10 animals cured) than treatment with individual agents or combination of control agents.

IgG4) fusion protein. We investigated whether co-treatment with an anti-CD47 antibody would potentiate the anti-tumor activity. 1×10$^7$ OPM-2 cells were implanted subcutaneously into the flank of SCID mice. Treatment started when tumors reached an average size of 130-170 mm$^3$. The mice were treated with i.p. injection of (a) vehicle or (b) 5 mg/kg of anti-CD38-attenuated IFNα2b fusion protein (h10A2-IgG4) (SEQ ID NOS 507/508) twice a week for four weeks or (c) anti-CD38 antibody (h10A2-IgG4) (SEQ ID NOS: 506/507) twice a week for four weeks; or (d) 5 mg/kg of non-glycosylated (to eliminate the effector function contribution) anti-CD47 antibody (SEQ ID NOS: 515/516) every other day for fourteen days; or (e) a combination regime of anti-CD38 antibody and non-glycosylated anti-CD47 antibody or (f) a combination regime of anti-CD38-attenuated IFNα2b fusion protein and non-glycosylated anti-CD47 antibody at the dosages described for single agents. Mean tumor volumes (+/−SEM) were monitored twice weekly and plotted as shown in FIG. 9.

None of the mice were cured by administration of only anti-CD38-attenuated IFNα2b fusion protein, or anti-CD38 antibody alone or anti-CD47 antibody alone. The combination of anti-CD38-attenuated IFNα2b fusion protein and anti-CD47 potentiated the activity of the anti-CD38-attenuated IFNα2b fusion protein, with 5 of the 10 mice treated with the combination regimen remaining tumor free after treatment stopped.

Solid Tumor Malignancy Model: A375 Melanoma

Figure 10:
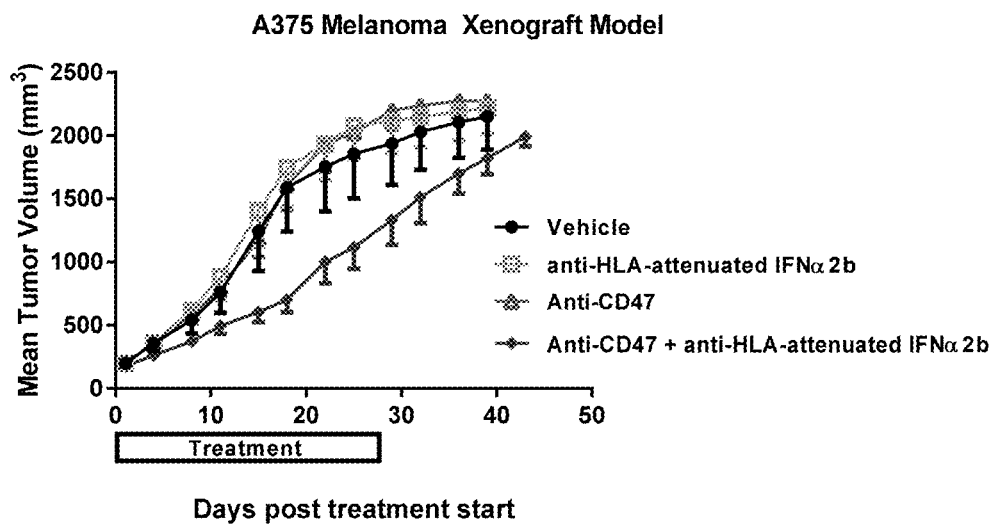
FIG. 10: Graph of tumor volumes in an A375 melanoma xenograft model showing results of treatment with an anti-HLA-attenuated IFNα2b fusion protein, with CD47 blockade using a non-glycosylated anti-CD47 antibody, or a combination of the anti-HLA-attenuated IFNα2b fusion protein and non-glycosylated anti-CD47 antibody, compared to vehicle. In this model, the combination of anti-HLA-attenuated IFNα2b fusion protein and non-glycosylated anti-CD47 antibody was more effective in delaying growth of A375 tumors than treatment with individual agents.

We also evaluated the contribution of the CD47:SIRPα axis towards an antibody targeted-attenuated IFNα2b activity in a melanoma solid tumor model. A xenograft study was performed in athymic nude mice with tumors generated from the A375 human melanoma cell line using the HB95 antibody, which binds to human, but not murine HLA (Barnstable et al., 1978, Cell 14:9-20). Ten million A375 cells mixed with matrigel were implanted into athymic nude mice. When tumors reached 1000 mm$^3$, tumors were excised, fragmented and small fragments were re-implanted into new hosts. On the third passage, fragments were implanted into athymic nude mice. When tumors reached an average volume of 170-200 mm$^3$, treatment was initiated (day 0). Mice were treated by i.p. administration of either (a) vehicle, or (b) 5 mg/kg anti-human HLA (HB95-IgG4) antibody targeted-attenuated IFNα2b fusion protein (SEQ ID NOS: 567/568) twice a week for 4 weeks, or (c) anti-CD47 antibody (SEQ ID NOS 513/514) at 5 mg/kg every other day for 14 days, or (d) a combination of anti-human HLA-antibody targeted-attenuated IFNα2b fusion protein and the anti-CD47 antibody or (e) a combination of an isotype control irrelevant antibody-attenuated interferon α2b fusion protein construct and an anti-CD47 antibody. Tumor volumes (Mean+/−SEM) were monitored twice a week and mean tumor volumes plotted as shown in FIG. 10.

The human HLA-targeted antibody-attenuated IFNα2b fusion protein is based on the HB95 antibody, which binds to human, but not murine, HLA (Barnstable et al., 1978, Cell 14:9-20) and therefore acts as a "universal" surrogate target for these studies. No activity in this xenograft model was seen with the anti-HLA antibody-attenuated IFNα2b fusion protein treatment alone or with the anti-CD47 antibody alone. When the two treatments were combined, however, significant tumor growth delay was observed. No inhibition of tumor growth was observed using the isotype control irrelevant antibody-attenuated IFNα2b fusion protein.

Hematological Malignancy Model: ARP-1 Myeloma

Figure 11:
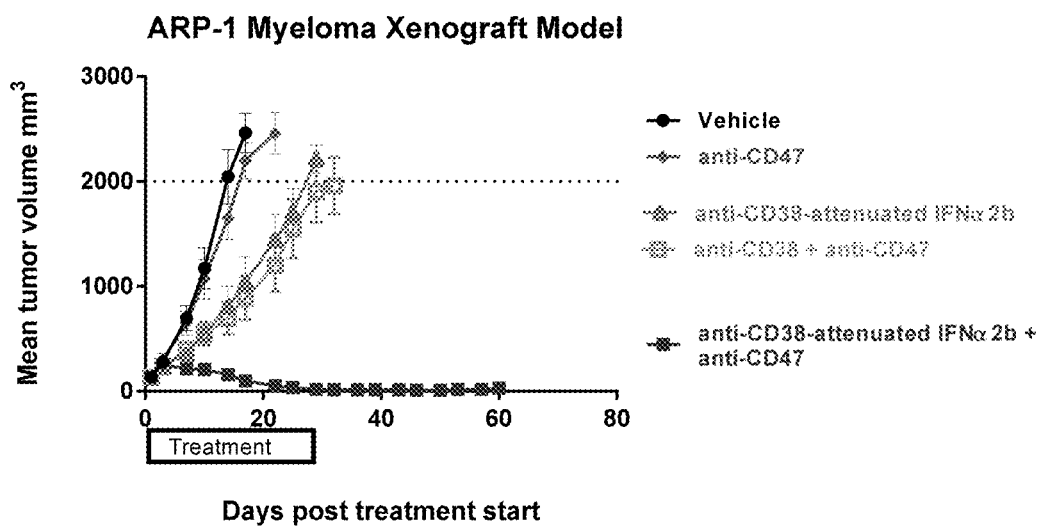
FIG. 11: Graph of tumor volumes in an ARP-1 refractory myeloma xenograft model showing results of treatment with an anti-CD38-attenuated IFNα2b fusion protein, with CD47 blockade using a non-glycosylated anti-CD47 antibody, or a combination of anti-CD38-attenuated IFNα2b fusion protein and non-glycosylated anti-CD47 antibody, compared to vehicle or controls. In this model, the combination of anti-CD38-attenuated IFNα2b fusion protein and CD47 blockade by non-glycosylated anti-CD47 antibody was significantly more effective in ablating tumors (7 of 8 animals cured) than treatment with individual agents or combination of control agents.

The combination of anti-CD38 antibody-attenuated IFNα2b fusion protein construct with non glysosylated anti-CD47 antibody was investigated in a refractory myeloma model. ARP-1 plasma cell myeloma cells were maintained as exponentially growing suspension cultures in standard growth media and conditions. The tumor cells used for implantation were harvested during log phase growth. Five million ARP-1 cells in 50% Matrigel were inoculated s.c. into the flank of SCID mice. Treatment was started when tumors reached an average size of 150 mm$^3$. The mice (n=8 in each group) were treated with i.p. injection of either (a) vehicle, (b) 5 mg/kg anti-CD38-attenuated IFNα2b (h10A2-hIgG4) fusion protein (SEQ ID NOS: 507/508) alone, (c) 5 mg/kg non-glycosylated anti-CD47 (B6H12-mIgG1) (SEQ ID NOS 515/516) antibody alone, (d) 5 mg/kg of the anti-CD38-attenuated IFNα2b (h10A2-hIgG4) fusion protein plus 5 mg/kg of the non-glycosylated anti-CD47 (B6H12-mIgG1) antibody (SEQ ID NOS 515/516), or (e) 5 mg/kg of anti-CD38 (h10A2-hIgG4) antibody (SEQ ID NOS: 506/507) plus 5 mg/kg of the non-glycosylated anti-CD47 (B6H12-mIgG1) antibody. All fusion proteins and the CD38 antibody were given twice weekly for four weeks. The anti-CD47 antibody was given every other day for 14 days. Tumor volumes were monitored twice a week and mean tumor volumes (SEM) were plotted as shown in FIG. 11. In this model only the combined treatment of CD38-attenuated IFNα2b (h10A2-hIgG4) fusion protein and the non-glycosylated anti-CD47 antibody (B6H12-mIgG1) was able to resolve tumors (7/8 animals cured).

Hematological Malignancy Model: ARP-1 Myeloma (2 Individual Clones of CD47)

Figure 12:
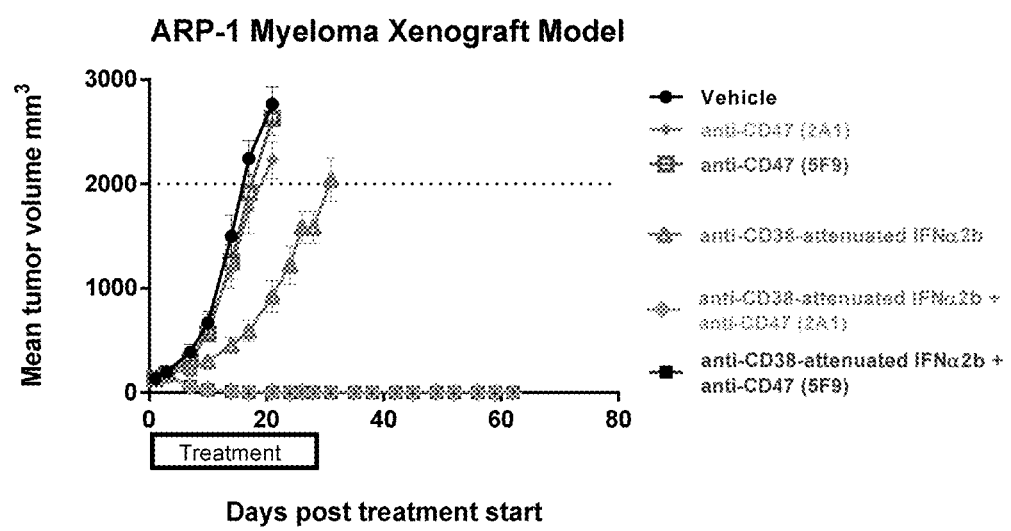
FIG. 12: Graph of tumor volumes in an ARP-1 refractory myeloma xenograft model with CD47 blockade provided by two different non-glycosylated anti-CD47 antibody clones (2A1 and 5F9) from the anti-CD47 antibody used in FIG. 11. Results in this model show that treatment with an anti-CD38-attenuated IFNα2b fusion protein combined with either of the two non-glycosylated anti-CD47 antibody clones (2A1 and 5F9) lead to complete tumor ablation in all animals (10 of 10 mice per group) compared to moderate or no effect on tumor growth by other treatments.

The combination of anti-CD38-attenuated IFNα2b fusion protein with two different anti-CD47 antibodies (clone 2A1 and clone 5F9) (SEQ ID NOS: 517/518 and SEQ ID NOS 519/520 respectively) was investigated in the refractory myeloma model ARP-1. The ARP-1 refractory myeloma xenograft model was performed as described above. Treatment was started when tumors reached an average size of 150 mm$^3$. The mice (n=10 in each group) were treated with i.p. injection of either (a) vehicle, (b) 5 mg/kg anti-CD38-attenuated IFNα2b (h10A2-hIgG4) fusion protein (SEQ ID NOS: 507/508) alone, (c) 5 mg/kg non-glycosylated anti-CD47 (2A1-mIgG1) (SEQ ID NOS: 517/518) antibody alone, (d) 5 mg/kg non-glycosylated anti-CD47 (5F9-IgG-mIgG1) (SEQ ID NOS: 519/520) antibody alone, (e) 5 mg/kg anti-CD38-attenuated IFNα2b (h10A2-hIgG4) fusion protein plus 5 mg/kg non-glycosylated anti-CD47 (2A1-mIgG1) antibody, or (f) 5 mg/kg anti-CD38-attenuated IFNα2b (h10A2-hIgG4) fusion protein with 5 mg/kg non-glycosylated anti-CD47 (5F9-mIgG1) antibody. All anti-CD38 antibody fusion protein were administered twice weekly for four weeks. The anti-CD47 antibodies were administered every other day for 14 days. Mean Tumor volumes were monitored twice a week and mean tumor volumes (+/−SEM) plotted as shown in FIG. 12. The combination treatment of anti-CD38-attenuated IFNα2b (h10A2-hIgG4) fusion protein with either of the non-glycosylated anti-CD47 antibody clones 2A1 or 5F9 (mIgG1) was able to completely resolve the myeloma xenografts (10/10 animals cured) in this model.

Hematological Malignancy Model: Hairy Cell Leukemia

Figure 13A:
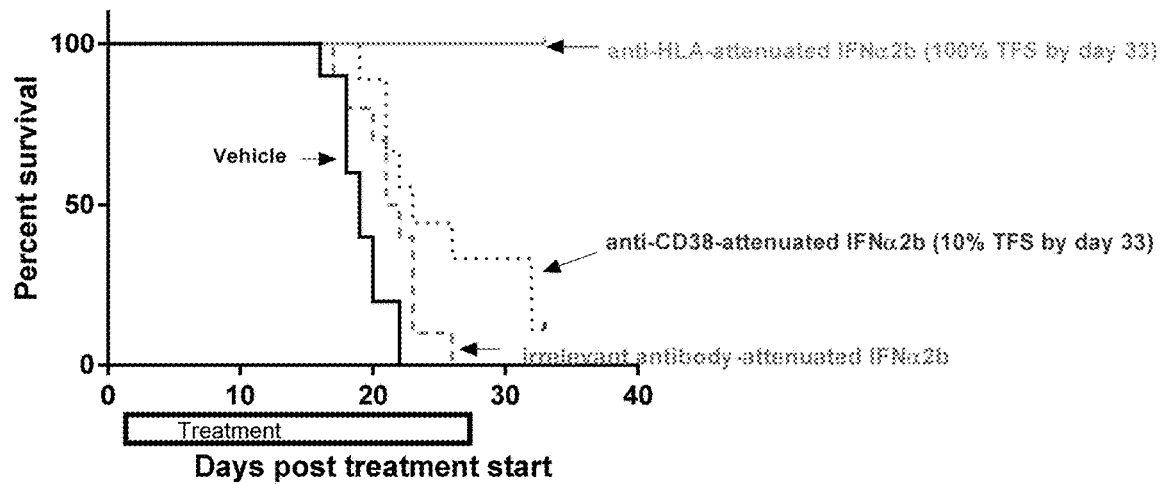
FIG. 13A: Graph of tumor free survival (TFS) in a Hairy Cell (HC-1) leukemia xenograft model showing results of treatment with anti-CD38-attenuated IFNα2b fusion protein, with anti-human HLA attenuated IFNα2b fusion protein (universal target antibody), or with irrelevant antibody-attenuated IFNα2b fusion protein. In this leukemia model, anti-CD38-attenuated IFNα2b fusion protein (as a single agent) provided minimal impact on survival (10% TFS by day 33) compared to anti-HLA attenuated IFNα2b fusion protein (100% TFS by day 33).

The impact of an anti-CD38-attenuated IFNα2b fusion protein on a human Hairy Cell Leukemia model was investigated. HC-1 Hairy Cell Leukemia cells were maintained as exponentially growing suspension cultures in standard growth media and conditions. The tumor cells were harvested during log phase growth and resuspended at a concentration of 1×10⁷ cells/mL in saline. One million HC-1 cells in saline solution were injected i.v. into each SCID mouse. Treatment started 5 days post inoculation and survival was monitored twice weekly (FIG. 13A). The mice (n=10 in each group) were treated with i.p. injection of either (a) vehicle, (b) 5 mg/kg anti-HLA-attenuated IFNα2b (HB95-hIgG4) fusion protein (SEQ ID NOS: 521/522) alone, (c) 5 mg/kg anti-CD38-attenuated IFNα2b (h10A2-hIgG4) fusion protein (SEQ ID NOS:507/508) alone, or (d) 5 mg/kg of an isotype control irrelevant antibody-attenuated IFNα2b (hIgG4) fusion protein alone. All fusion proteins were administered twice weekly for four weeks. In this leukemia model, the anti-CD38-attenuated IFNα2b fusion protein (as a single agent) provided minimal impact on survival (10% Tumor Free Survival (TFS) by day 33) when compared to a positive control anti-human HLA attenuated IFNα2b antibody fusion protein (100% TFS by day 33). Of note, CD38 is expressed at a significantly lower level on this cell line than HLA, which may explain the modest activity of the anti-CD38-attenuated IFNα2b fusion protein.

The HC-1 Hairy Cell Leukemia model was investigated for impact of combined therapy of the anti-CD38-attenuated IFNα2b fusion protein construct with a non-glycosylated anti-CD47 antibody. One million HC-1 cells in saline solution were injected i.v. into each SCID mouse. Treatment started 5 days post inoculation and survival and was monitored twice weekly (FIG. 12B). The mice (n=10 in each group) were treated with i.p. injection of either (a) vehicle, (b) 5 mg/kg anti-HLA-attenuated IFNα2b (HB95-hIgG4) fusion protein (SEQ ID NOS: 521/522) alone, (c) a combination of 5 mg/kg anti-CD38-attenuated IFNα2b (h10A2-hIgG4) fusion protein (SEQ ID NOS: 507/508) and 5 mg/kg non-glycosylated anti-CD47 antibody (B6H12-mIgG1) (SEQ ID NOS: 515/516), (d) a combination of 5 mg/kg isotype control irrelevant antibody-attenuated IFNα2b (IgG4) fusion protein and 5 mg/kg non-glycosylated anti-CD47 antibody (B6H12-mIgG1), or (e) 5 mg/kg anti-CD20-attenuated IFNα2b (antiCD20-hIgG4) fusion protein (SEQ ID NOS: 525/526) alone, or (f) a combination of 5 mg/kg anti-CD20-attenuated IFNα2b (antiCD20-hIgG4) fusion protein (SEQ ID NOS:525/526) with non-glycosylated anti-CD47 (B6H12-mIgG4). All fusion proteins were given twice weekly for four weeks. The anti-CD47 antibody was given every other day for 14 days.

Figure 13B:
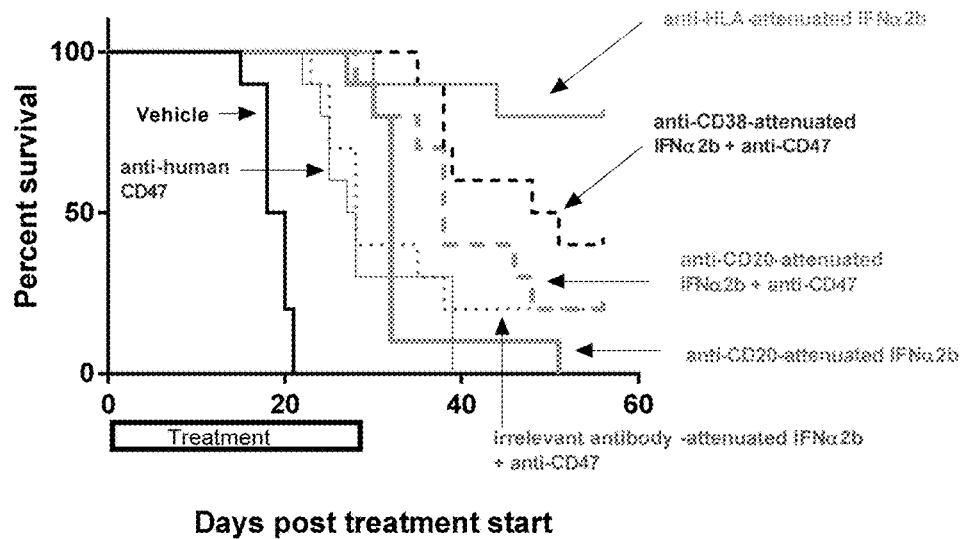
FIG. 13B: Graph of tumor free survival (TFS) in a Hairy Cell (HC-1) leukemia xenograft model showing results of treatment with anti-CD38-attenuated IFNα2b fusion protein in combination with non-glycosylated anti-CD47 antibody, compared to anti-human HLA attenuated IFNα2b fusion protein (universal target antibody), anti-CD20 attenuated IFNα2b fusion protein alone or in combination with non-glycosylated anti-CD47 antibody, or vehicle. Results in this model show that the combination of anti-CD38-attenuated IFNα2b fusion protein with anti-CD47 antibody significantly improved survival (40% TFS by day 50) when compared to anti-CD38-attenuated IFNα2b fusion protein alone in the previous experiment (FIG. 13A).

In this model, enhanced survival of animals was observed with the combinations of the anti human CD38-attenuated IFNα2b (h10A2-hIgG4) fusion protein and non-glycosylated anti-CD47 (B6H12-mIgG1) antibody (40% TFS) when compared to the results presented in FIG. 13A where anti human CD38-attenuated IFNα2b (h10A2-hIgG4) fusion protein alone provided only 10% TFS. Enhanced survival of animals was also observed with the combination of anti-CD20-attenuated IFNα2b (antiCD20-hIgG4) fusion protein and non-glycosylated CD47 (20% TFS). (FIG. 13B).

Hematological Malignancy Model: CCRF CEM, T Cell Acute Lymphoblastoid Leukemia

Figure 14:
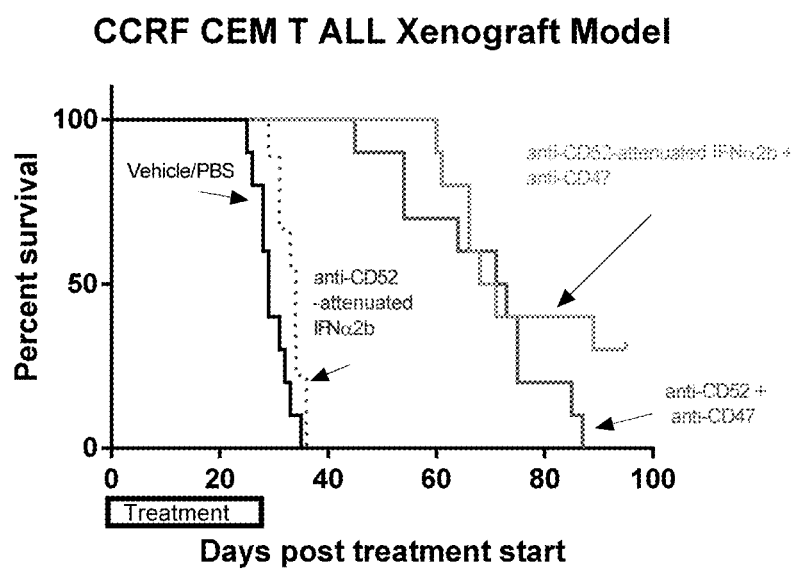
FIG. 14: Graph of tumor free survival (TFS) in a CCRF-CEM T ALL xenograft model showing results of treatment with anti-CD52-attenuated IFNα2b fusion protein alone or in combination with non-glycosylated anti-CD47 antibody compared to treatments with control antibodies or vehicle. Results in this model show that the combination of anti-CD52-attenuated IFNα2b fusion protein in combination with non-glycosylated anti-CD47 antibody lead to enhanced and prolonged survival (30% TFS by day 90) compared to individual agents or combination of control antibodies.

The combination of an anti-CD38-attenuated IFNα2b fusion protein and an anti-CD47 naked antibody led to enhanced anti-tumor response in a T cell Acute Lymphoblastoid Leukemia model based on cell line CCRF CEM. CCRF CEM, T cell Acute Lymphoblastoid Leukemia cells were maintained as exponentially growing suspension cultures in standard growth media and conditions. The tumor cells used for implantation were harvested during log phase growth. Five million CCRF CEM cells in saline solution were inoculated i.v. into SCID mice. Treatment started 7 days post inoculation where survival was monitored (FIG. 14). The mice (n=10 in each group) were treated with i.p. injection of either (a) vehicle, (b) 5 mg/kg anti-CD52-attenuated IFNα2b (antiCD52-hIgG4) fusion protein (SEQ ID NOS: 523/524) alone, (c) anti-CD52-attenuated IFNα2b (antiCD52-hIgG4) fusion protein plus 5 mg/kg non-glycosylated anti-CD47 (B6H12-IgG1) antibody (SEQ ID NOS: 515/516), or (d) 5 mg/kg anti-CD52 (antiCD52-hIgG1) antibody (SEQ ID NOS: 523/537) with 5 mg/kg non-glycosylated anti-CD47 (B6H12-mIgG1) antibody. All fusion proteins and anti-CD52 antibodies were administered twice weekly for four weeks. Anti-CD47 antibody was administered every other day for 14 days.

In this model the anti-CD47 antibody in combination with either naked anti-CD52 antibody or anti-CD52-attenuated IFNα2b fusion protein showed enhanced survival compared to vehicle or anti-CD52-attenuated IFNα2b fusion protein alone. At the end of the study the anti-CD47 antibody combined with anti-CD52-attenuated IFNα2b fusion protein provided enhanced survival (30% TFS) compared to anti-CD47 antibody combined with anti-CD52 antibody (no survival).

Hematological Malignancy Model: MEC-1, Chronic B Cell Leukemia

Combination treatment of fusion proteins with non-glycosylated anti-CD47 antibody were tested in a MEC-1 chronic B Cell Leukemia cells. MEC-1 chronic B Cell Leukemia cells were maintained as exponentially growing suspension cultures in standard growth media and conditions. Five million MEC-1 cells in saline solution were inoculated i.v. into each SCID mouse. Treatment started 8 days post inoculation and survival was monitored (FIG. 14). The mice (n=10 in each group) were treated with i.p. injection of either (a) vehicle, (b) 5 mg/kg anti-HLA-attenuated IFNα2b (HB95-hIgG4) fusion protein (SEQ ID NOS: 521/522) alone, (c) 5 mg/kg anti-HLA-attenuated IFNα2b (HB95-hIgG4) fusion protein plus 5 mg/kg non-glycosylated anti-CD47 (B6H12, mIgG1) antibody (SEQ ID NOS: 515/516), (d) 5 mg/kg isotype control irrelevant antibody-attenuated IFNα2b (hIgG4 isotype) fusion protein plus 5 mg/kg non-glycosylated anti-CD47 (B6H12, mIgG1) antibody, (e) 5 mg/kg anti-CD19-attenuated IFNα2b (16C4-hIgG4) fusion protein (SEQ ID NOS: 527/528) alone, or (f) 5 mg/kg anti-CD19-attenuated IFNα2b (16C4-hIgG4) fusion protein with non-glycosylated anti-CD47 (B6H12, mIgG1) antibody. All fusion proteins and the anti-CD19 antibody were given twice weekly for four weeks. Non-glycosylated anti-CD47 antibody was given every other day for 14 days.

Figure 15:
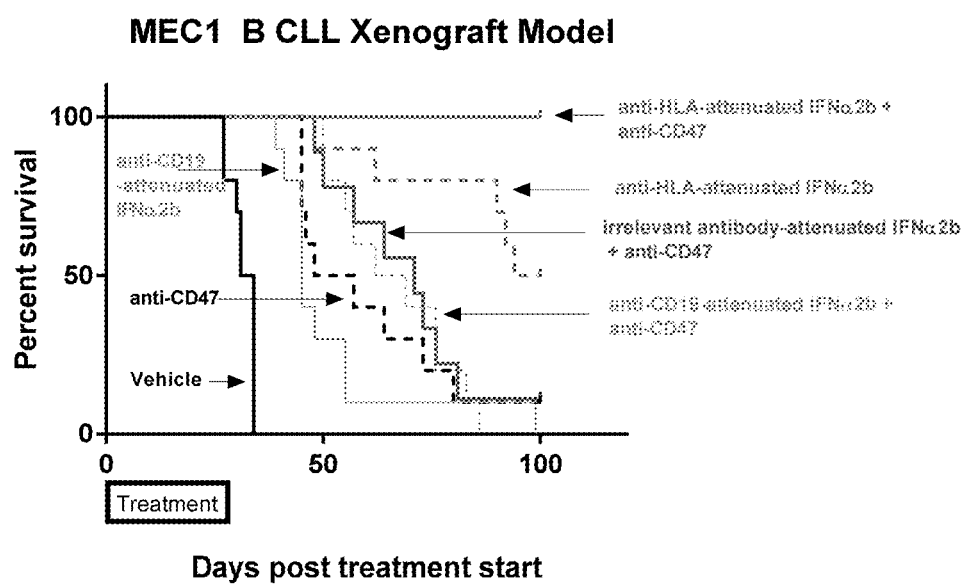
FIG. 15: Graph of tumor free survival (TFS) in a systemic B-cell chronic lymphocytic leukemia (B-CLL) tumor MEC1 B CLL xenograft model showing results of treatment with anti-HLA-attenuated IFNα2b fusion protein alone or in combination with non-glycosylated anti-CD47 antibody, or anti-CD19 attenuated IFNα2b fusion protein alone or with non-glycosylated anti-CD47 antibody compared to treatments with control antibodies or vehicle. Results in this model show that anti-HLA-attenuated IFNα2b fusion protein therapy alone improved survival (50% TFS at day 90), however survival was greatly enhanced when anti-HLA-attenuated IFNα2b fusion protein was combined with non-glycosylated anti-CD47 antibody (100% TFS at day 90). Survival was also moderately enhanced when anti-CD19 attenuated IFNα2b fusion protein was combined with non-glycosylated anti-CD47 antibody compared to anti-CD19 attenuated IFNα2b fusion protein alone.

In this model the combination of anti-CD47 blockade and anti-HLA-attenuated IFNα2b fusion protein was effective in promoting animal survival (FIG. 15). The anti-CD19 antibody-attenuated IFNα2b fusion protein plus 5 mg/kg non-glycosylated anti-CD47 antibody showed delayed tumor growth compared to single agents but was similar to the effect seen with the isotype control irrelevant antibody-attenuated IFNα2b fusion protein combination with the anti-human CD47 antibody.

Solid Tumor Malignancy Model: H820 Non-Small Cell Lung Cancer (NSCLC)

Figure 16:
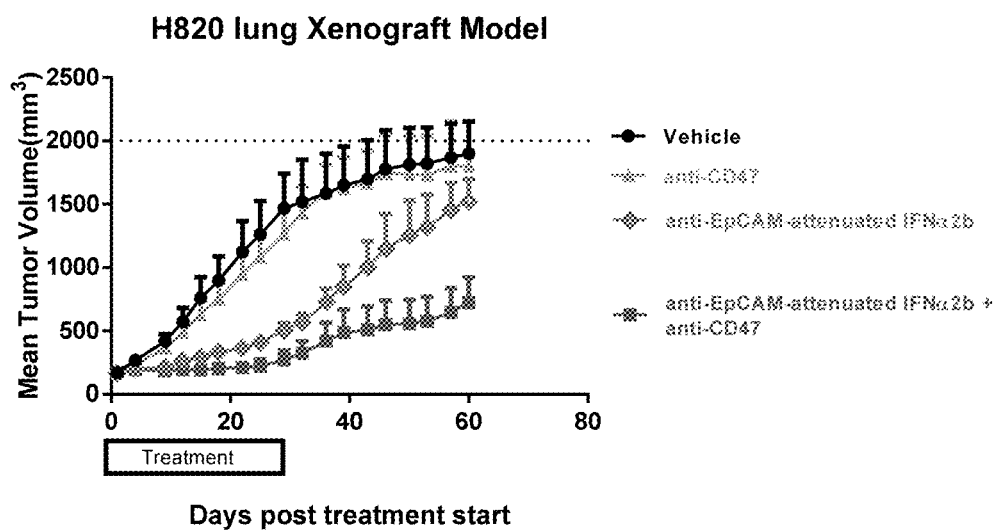
FIG. 16: Graph of tumor volumes in a NSCLC (H820) xenograft model showing results of treatment with anti-EpCAM-attenuated IFNα2b fusion protein alone or in combination with non-glycosylated anti-CD47 antibody compared to anti-CD47 antibody alone or vehicle treatments. In this model, the combination of anti-EpCAM-attenuated IFNα2b fusion protein with non-glycosylated anti-CD47 antibody provided enhanced tumor inhibition beyond that of human EpCAM-attenuated IFNα2b fusion protein alone or anti-CD47 antibody alone.

Treatments with a combination of fusion protein constructs with a non-glycosylated anti-CD47 antibody were tested in a non small cell lung cancer model based on cell line, H820. H820 lung non small cancer cells were maintained as exponentially growing suspension cultures in standard growth media and conditions. Ten million H820 cells mixed with matrigel were implanted into athymic nude mice. When tumors reached 1000 mm³, tumors were excised, fragmented and small fragments were re-implanted into new hosts. On the third passage, fragments were implanted into athymic nude mice. When tumors reached an average volume of 150 mm³, treatment was initiated (day 0). The mice (n=10 in each group) were treated with i.p. injection of either (a) vehicle, (b) 5 mg/kg anti-EpCAM-attenuated IFNα2b (EpAb 2-6-hIgG4) fusion protein (SEQ ID NOS: 529/530) alone, (c) 5 mg/kg anti-EpCAM-attenuated IFNα2b (EpAb 2-6-hIgG4) fusion protein (SEQ ID NOS: 529/530) plus 5 mg/kg anti-CD47 (B6H12-mIgG1) (SEQ ID NOS 515/516) antibody, or (d) 5 mg/kg anti-CD47 (B6H12-mIgG1) antibody alone. All fusion protein constructs were administered twice weekly for four weeks. Anti-CD47 antibody was administered every other day for 14 days. Tumor volumes were monitored twice a week and mean tumor volumes plotted (+/−SEM) as shown in FIG. 16.

The combination therapy of the anti-EpCAM-attenuated IFNα2b fusion protein with the anti-CD47 antibody provided enhanced inhibition of H820 tumor beyond that of the anti-EpCAM-attenuated IFNα2b fusion protein alone.

Example 8

Macrophage Involvement in Anti CD38-Attenuated Interferon α2b Fusion Protein Activity in Weakly Responsive Model, OPM2

Figure 17A:
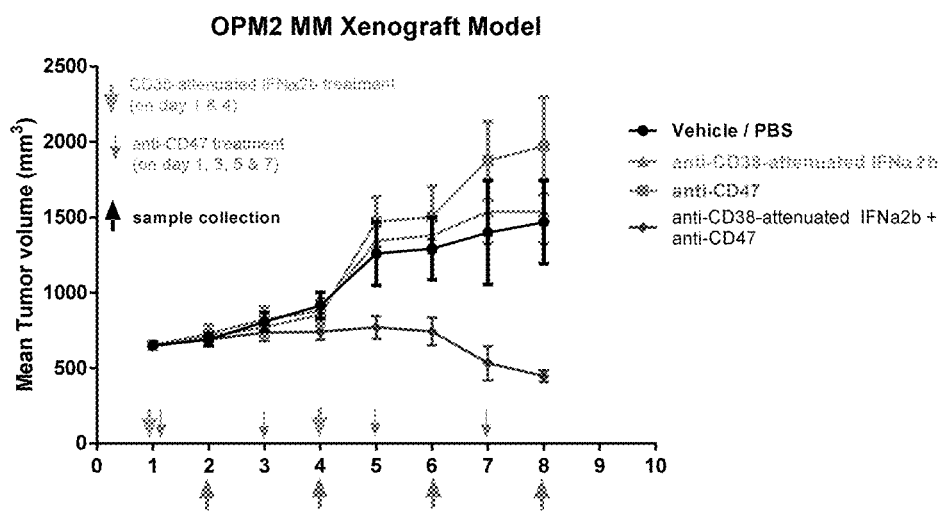
FIG. 17A: Graph of tumor volumes in an OPM2 myeloma xenograft model showing results of treatment with anti-CD38-attenuated IFNα2b fusion protein alone or with non-glycosylated anti-CD47 antibody, non-glycosylated anti-CD47 antibody alone, or vehicle. Black arrows indicate the time points of treatments, and grey arrows indicate the time points for sampling of tumors for histological analysis. In this model, enhanced tumor inhibition was observed only in animals treated with the combined therapy of anti-CD38-attenuated IFNα2b fusion protein with non-glycosylated anti-CD47 antibody.

The role of macrophage infiltration in OPM-2, a weakly-responsive Multiple Myeloma xenograft tumor model was investigated. This study was performed in a similar manner as the myeloma xenograft model described above in Example 2. Cells were grown, prepared and implanted into SCID mice as described in Example 1. Tumors were allowed to grow to an average volume of 600-750 mm³ before treatment began. Mice (12/cohort) were treated intraperitoneally with either (a) PBS vehicle, (b) 5 mg/kg anti CD38-attenuated IFNα2b (h10A2-IgG4) fusion protein (SEQ ID NOS: 507/508) alone on days 1 and 4 (thick gray arrows shown above x-axis in FIG. 17A) or (c) 5 mg/kg anti CD38-attenuated IFNα2b fusion protein plus 5 mg/kg anti-CD47 antibody (B6H12-mIgG1) (SEQ ID NOS 513/514) on days 1, 3, 5 and 7 (thin gray arrows shown above x-axis in FIG. 17A). Tumor size was measured daily and mean (+/−SEM) tumor volumes were plotted in FIG. 17A. At selected time points (black arrows) tumors were excised from 3 mice from each group and frozen for immunohistochemistry evaluation, described below. Cross sections of excised tumors (2 from each group) were mounted and stained with hematoxylin for tumor size comparison.

Figure 17B:
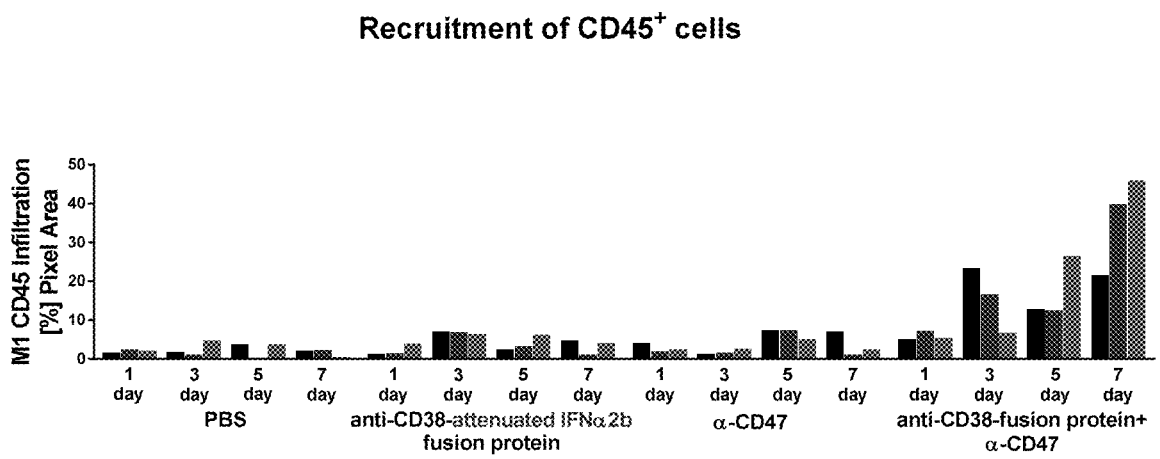
FIG. 17B: Graph of the scoring from histological analysis of tumor samples taken from the experiment shown in FIG. 17A. Strong recruitment of CD45+ cells was observed in tumors treated with the combination of anti-CD38-attenuated IFNα2b fusion protein with non-glycosylated anti-CD47 antibody compared to weak CD45+ cell recruitment by either agent alone or vehicle. Each bar is a representative of a single mouse.
Figure 18A:
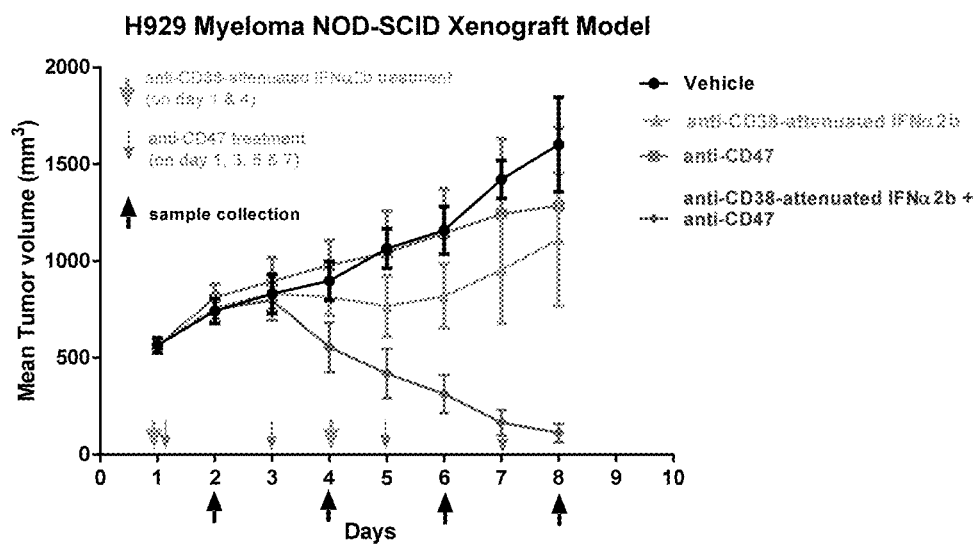
FIG. 18A: Graph of tumor volumes in an H929 myeloma xenograft model using NOD SCID mice showing results of treatment with anti-CD38-attenuated IFNα2b fusion protein alone or with non-glycosylated anti-CD47 antibody, non-glycosylated anti-CD47 antibody alone, or vehicle. Black arrows indicate the time points of treatments, and grey arrows indicate the time points for sampling of tumors for histological analysis. In this model, robust tumor inhibition was observed with the combined therapy of anti-CD38-attenuated IFNα2b fusion protein and non-glycosylated anti-CD47 antibody, while anti-CD38-attenuated IFNα2b fusion protein alone provided a small anti-tumor response.
Figure 18B:
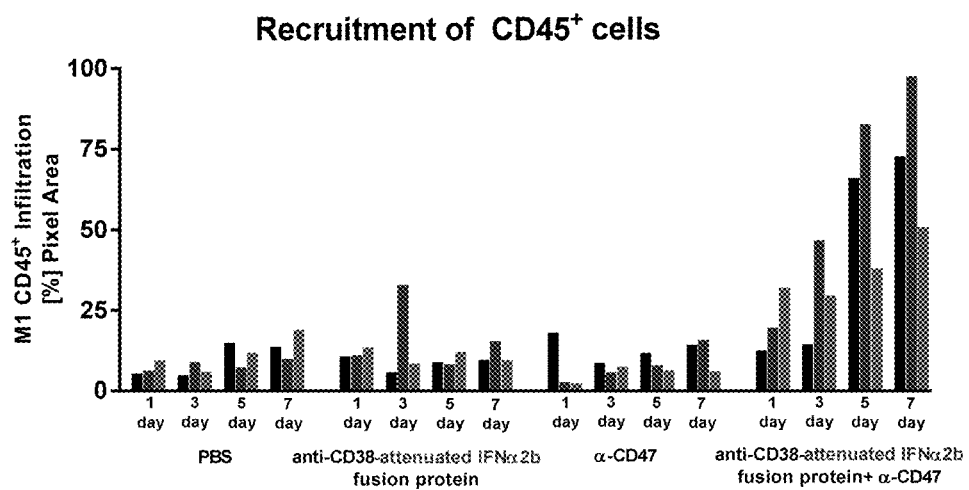
FIG. 18B: Graph of the scoring from histological analysis of tumor samples taken from the experiment shown in FIG. 18A. Strong recruitment of CD45+ cells was observed in tumors treated with the combination of anti-CD38-attenuated IFNα2b fusion protein with non-glycosylated anti-CD47 antibody compared to weak CD45+ cell recruitment by either agent alone or vehicle. Each bar is a representative of a single mouse.

In a model of a weakly responsive xenograft tumor, mice with these human tumors treated with the anti-CD38-attenuated IFNα2b (h10A2-IgG4) fusion protein showed a small anti-tumor response with no increased infiltration of macrophages, as illustrated in FIG. 18B. The lack of anti-tumor response and lack of macrophage infiltration is consistent with a relationship association between macrophage infiltration and an anti-tumor response following exposure of the tumor to a targeted antibody-attenuated IFNα2b fusion protein. However, dual treatment with the anti-CD38-attenuated IFNα2b fusion protein and the anti-CD47 antibody did lead to strong anti-tumor activity and, correspondingly, to increased infiltration of macrophages (FIG. 17B). This further supports the role of macrophages in the mechanism of tumor eradication by tumor-targeting antibody-attenuated IFNα fusion proteins, and supports the utility of combining CD47 blockade with such fusion proteins.

Example 9

Macrophage Involvement in Anti CD38-Attenuated Interferon α2b Fusion Protein Activity in Responsive Myeloma H929 in NOD SCID Xenograft Model The role of macrophage infiltration in NCI-H929, a responsive MM xenograft tumor model was further investigated using NOD SCID mice. NOD SCID is a strain of mouse characterized as having defective macrophages (SIRPα axis), dendritic cells, NK cells and no complement system.

NCI-H929 cells were grown, prepared and implanted into mice as described in Example 1. This study was performed in a similar manner as the myeloma xenograft model described in Example 2 except that NOD SCID, rather than SCID, mice were used. Tumors were allowed to grow to an average volume of 600-750 mm³ before treatment began. Mice (n=12 per group) were treated intraperitoneally with either (a) PBS vehicle, (b) 5 mg/kg anti-CD38-attenuated IFNα2b (h10A2-IgG4) fusion protein (SEQ ID NOS: 507/508) alone on days 1 and 4 (thick grey arrows shown above x-axis in FIG. 19A) or (c) 5 mg/kg anti-CD38-attenuated IFNα2b fusion protein combined with 5 mg/kg anti-CD47 antibody (B6H12-mIgG1) (SEQ ID NOS 515/516) on days 1, 3, 5 and 7 (thin gray arrows shown above x-axis in FIG. 18A). Tumor size was measured daily and mean (+/−SEM) tumor volumes were plotted in FIG. 18A. At selected time points (black arrows) tumors were excised from 3 mice from each group and frozen for immunohistochemistry evaluation described below in detail. Cross sections of excised tumors (2 from each group) were mounted and stained with hematoxylin for tumor size comparison.

In this study mice that were treated with the anti-CD38-attenuated IFNα2b fusion protein showed a limited anti-tumor response and, correspondingly, no increased infiltration of macrophages, as illustrated in FIG. 18B. In contrast, the combination treatment of the anti-CD38-attenuated IFNα2b fusion protein with a non-glycosylated anti-CD47 antibody restored the anti-tumor activity, as well as the macrophage infiltration, to a level which was comparable to that observed in SCID mice (FIG. 18A) treated with the anti-CD38-attenuated IFNα2b fusion protein alone (FIG. 18B). This further supports the role of macrophages in the mechanism of tumor eradication by tumor-targeting antibody-attenuated IFNα fusion proteins, and supports the utility of combining CD47 blockade with such fusion proteins.

Sequence Tables

| SEQ ID NO: | Species | Gene | Subtype | Variant |
|---|---|---|---|---|
| 1 | human | IFN | α1b | native |
| 2 | human | IFN | α2a | native |
| 3 | human | IFN | α2b | native |
| 4 | human | IFN | α2b | L15A |
| 5 | human | IFN | α2b | A19W |
| 6 | human | IFN | α2b | R22A |

| | | | | -continued |
|---|---|---|---|---|
| 7 | human | IFN | α2b | R23A |
| 8 | human | IFN | α2b | S25A |
| 9 | human | IFN | α2b | L26A |
| 10 | human | IFN | α2b | F27A |
| 11 | human | IFN | α2b | L30A |
| 12 | human | IFN | α2b | L30V |
| 13 | human | IFN | α2b | K31A |
| 14 | human | IFN | α2b | D32A |
| 15 | human | IFN | α2b | R33K |
| 16 | human | IFN | α2b | R33A |
| 17 | human | IFN | α2b | R33Q |
| 18 | human | IFN | α2b | H34A |
| 19 | human | IFN | α2b | Q40A |
| 20 | human | IFN | α2b | D114R |
| 21 | human | IFN | α2b | L117A |
| 22 | human | IFN | α2b | R120A |
| 23 | human | IFN | α2b | R120E |
| 24 | human | IFN | α2b | R125A |
| 25 | human | IFN | α2b | R125E |
| 26 | human | IFN | α2b | K131A |
| 27 | human | IFN | α2b | E132A |
| 28 | human | IFN | α2b | K133A |
| 29 | human | IFN | α2b | K134A |
| 30 | human | IFN | α2b | R144A |
| 31 | human | IFN | α2b | R144D |
| 32 | human | IFN | α2b | R144E |
| 33 | human | IFN | α2b | R144G |
| 34 | human | IFN | α2b | R144H |
| 35 | human | IFN | α2b | R144I |
| 36 | human | IFN | α2b | R144K |
| 37 | human | IFN | α2b | R144L |
| 38 | human | IFN | α2b | R144N |
| 39 | human | IFN | α2b | R144Q |
| 40 | human | IFN | α2b | R144S |
| 41 | human | IFN | α2b | R144T |
| 42 | human | IFN | α2b | R144V |
| 43 | human | IFN | α2b | R144Y |
| 44 | human | IFN | α2b | A145D |
| 45 | human | IFN | α2b | A145E |
| 46 | human | IFN | α2b | A145G |
| 47 | human | IFN | α2b | A145H |
| 48 | human | IFN | α2b | A145I |
| 49 | human | IFN | α2b | A145K |
| 50 | human | IFN | α2b | A145L |
| 51 | human | IFN | α2b | A145M |
| 52 | human | IFN | α2b | A145N |
| 53 | human | IFN | α2b | A145Q |
| 54 | human | IFN | α2b | A145R |
| 55 | human | IFN | α2b | A145S |
| 56 | human | IFN | α2b | A145T |
| 57 | human | IFN | α2b | A145V |
| 58 | human | IFN | α2b | A145Y |
| 59 | human | IFN | α2b | M148A |
| 60 | human | IFN | α2b | R149A |
| 61 | human | IFN | α2b | S152A |
| 62 | human | IFN | α2b | L153A |
| 63 | human | IFN | α2b | N156A |
| 64 | human | IFN | α2b | L30A + YNS |
| 65 | human | IFN | α2b | R33A + YNS |
| 66 | human | IFN | α2b | M148A + YNS |
| 67 | human | IFN | α2b | L153A + YNS |
| 68 | human | IFN | α2b | R144A + YNS |
| 69 | human | IFN | α2b | N65A, L80A, Y85A, Y89A |
| 70 | human | IFN | α2b | N65A, L80A, Y85A, Y89A, D114A |
| 71 | human | IFN | α2b | N65A, L80A, Y85A, Y89A, L117A |
| 72 | human | IFN | α2b | N65A, L80A, Y85A, Y89A, R120A |
| 73 | human | IFN | α2b | Y85A, Y89A, R120A |
| 74 | human | IFN | α2b | D114A, R120A |
| 75 | human | IFN | α2b | L117A, R120A |
| 76 | human | IFN | α2b | L117A, R120A, K121A |
| 77 | human | IFN | α2b | R120A, K121A |
| 78 | human | IFN | α2b | R120E, K121E |
| 79 | human | IFN | α2b | Δ[L161 – E165] |
| 80 | human | IFN | α4b | native |
| 81 | human | IFN | α5 | native |
| 82 | human | IFN | α6 | native |
| 83 | human | IFN | α7 | native |
| 84 | human | IFN | α8 | native |
| 85 | human | IFN | α10 | native |

-continued

| | | | | |
|---|---|---|---|---|
| 86 | human | IFN | α1a/13 | native |
| 87 | human | IFN | α14 | native |
| 88 | human | IFN | α16 | native |
| 89 | human | IFN | α17 | native |
| 90 | human | IFN | α21 | native |
| 91 | human | IFN | β1(a) | native |
| 92 | human | IFN | β1(a) | R27A |
| 93 | human | IFN | β1(a) | R35T |
| 94 | human | IFN | β1(a) | E42K |
| 95 | human | IFN | β1(a) | D54N |
| 96 | human | IFN | β1(a) | M62I |
| 97 | human | IFN | β1(a) | G78S |
| 98 | human | IFN | β1(a) | K123A |
| 99 | human | IFN | β1(a) | C141Y |
| 100 | human | IFN | β1(a) | A142T |
| 101 | human | IFN | β1(a) | E149K |
| 102 | human | IFN | β1(a) | R152H |
| 103 | human | IFN | β1(b) | C17S |
| 104 | human | IFN | β1(b) | C17S, R35A |
| 105 | human | IFN | β1(b) | C17S, R147A |
| 106 | human | CD38 | human | tagged, ECD |
| 107 | cynomolgus | CD38 | cynomolgus | tagged, ECD |
| 108 | human | CD38 | human | ECD, for genetic immunisation (DNA) |
| 109 | human | CD38 | human | ECD, for genetic immunisation (translated) |
| 110 | human | CD38 | human | native |

| SEQ ID NO: | Protein Name | Chain | Species |
|---|---|---|---|
| 111 | G005 IgG1 (anti-CD38) | LC aa | human |
| 112 | | HC aa | human |
| 113 | | LC DNA | human |
| 114 | | HC DNA | human |
| 111 | G005-HC-L0-IFNα(R144A) IgG1 | LC aa | human |
| 115 | | HC aa | synthetic |
| 113 | | LC DNA | human |
| 116 | | HC DNA | synthetic |
| 111 | G005-HC-L6-IFNα(R144A) IgG1 | LC aa | human |
| 117 | | HC aa | synthetic |
| 113 | | LC DNA | human |
| 118 | | HC DNA | synthetic |
| 111 | G005-HC-L0-IFNα(A145G) IgG1 | LC aa | human |
| 119 | | HC aa | synthetic |
| 113 | | LC DNA | human |
| 120 | | HC DNA | synthetic |
| 111 | G005-HC-L6-IFNα(A145G) IgG1 | LC aa | human |
| 121 | | HC aa | synthetic |
| 113 | | LC DNA | human |
| 122 | | HC DNA | synthetic |
| 111 | G005-HC-L6-IFNα(R144A) IgG4 | LC aa | human |
| 123 | | HC aa | synthetic |
| 113 | | LC DNA | human |
| 124 | | HC DNA | synthetic |
| 111 | G005-HC-L6-IFNα(A145G) IgG4 | LC aa | human |
| 125 | | HC aa | synthetic |
| 113 | | LC DNA | human |
| 126 | | HC DNA | synthetic |
| 111 | G005-HC-L0-IFNα IgG4 | LC aa | human |
| 127 | | HC aa | synthetic |
| 113 | | LC DNA | human |
| 128 | | HC DNA | synthetic |
| 111 | G005-HC-L0-IFNα(R144A) IgG4 | LC aa | human |
| 129 | | HC aa | synthetic |
| 113 | | LC DNA | human |
| 130 | | HC DNA | synthetic |
| 111 | G005-HC-L0-IFNα(R144D) IgG4 | LC aa | human |
| 131 | | HC aa | synthetic |
| 113 | | LC DNA | human |
| 132 | | HC DNA | synthetic |
| 111 | G005-HC-L0-IFNα(R144E) IgG4 | LC aa | human |
| 133 | | HC aa | synthetic |
| 113 | | LC DNA | human |
| 134 | | HC DNA | synthetic |
| 111 | G005-HC-L0-IFNα(R144G) IgG4 | LC aa | human |
| 135 | | HC aa | synthetic |
| 113 | | LC DNA | human |
| 136 | | HC DNA | synthetic |

-continued

| | | | |
|---|---|---|---|
| 111 | G005-HC-L0-IFNα(R144H) IgG4 | LC aa | human |
| 137 | | HC aa | synthetic |
| 113 | | LC DNA | human |
| 138 | | HC DNA | synthetic |
| 111 | G005-HC-L0-IFNα(R144I) IgG4 | LC aa | human |
| 139 | | HC aa | synthetic |
| 113 | | LC DNA | human |
| 140 | | HC DNA | synthetic |
| 111 | G005-HC-L0-IFNα(R144K) IgG4 | LC aa | human |
| 141 | | HC aa | synthetic |
| 113 | | LC DNA | human |
| 142 | | HC DNA | synthetic |
| 111 | G005-HC-L0-IFNα(R144L) IgG4 | LC aa | human |
| 143 | | HC aa | synthetic |
| 113 | | LC DNA | human |
| 144 | | HC DNA | synthetic |
| 111 | G005-HC-L0-IFNα(R144N) IgG4 | LC aa | human |
| 145 | | HC aa | synthetic |
| 113 | | LC DNA | human |
| 146 | | HC DNA | synthetic |
| 111 | G005-HC-L0-IFNα(R144Q) IgG4 | LC aa | human |
| 147 | | HC aa | synthetic |
| 113 | | LC DNA | human |
| 148 | | HC DNA | synthetic |
| 111 | G005-HC-L0-IFNα(R144S) IgG4 | LC aa | human |
| 149 | | HC aa | synthetic |
| 113 | | LC DNA | human |
| 150 | | HC DNA | synthetic |
| 111 | G005-HC-L0-IFNα(R144T) IgG4 | LC aa | human |
| 151 | | HC aa | synthetic |
| 113 | | LC DNA | human |
| 152 | | HC DNA | synthetic |
| 111 | G005-HC-L0-IFNα(R144V) IgG4 | LC aa | human |
| 153 | | HC aa | synthetic |
| 113 | | LC DNA | human |
| 154 | | HC DNA | synthetic |
| 111 | G005-HC-L0-IFNα(R144Y) IgG4 | LC aa | human |
| 155 | | HC aa | synthetic |
| 113 | | LC DNA | human |
| 156 | | HC DNA | synthetic |
| 111 | G005-HC-L0-IFNα(A145D) IgG4 | LC aa | human |
| 157 | | HC aa | synthetic |
| 113 | | LC DNA | human |
| 158 | | HC DNA | synthetic |
| 111 | G005-HC-L0-IFNα(A145E) IgG4 | LC aa | human |
| 159 | | HC aa | synthetic |
| 113 | | LC DNA | human |
| 160 | | HC DNA | synthetic |
| 111 | G005-HC-L0-IFNα(A145G) IgG4 | LC aa | human |
| 161 | | HC aa | synthetic |
| 113 | | LC DNA | human |
| 162 | | HC DNA | synthetic |
| 111 | G005-HC-L0-IFNα(A145H) IgG4 | LC aa | human |
| 163 | | HC aa | synthetic |
| 113 | | LC DNA | human |
| 164 | | HC DNA | synthetic |
| 111 | G005-HC-L0-IFNα(A145I) IgG4 | LC aa | human |
| 165 | | HC aa | synthetic |
| 113 | | LC DNA | human |
| 166 | | HC DNA | synthetic |
| 111 | G005-HC-L0-IFNα(A145K) IgG4 | LC aa | human |
| 167 | | HC aa | synthetic |
| 113 | | LC DNA | human |
| 168 | | HC DNA | synthetic |
| 111 | G005-HC-L0-IFNα(A145L) IgG4 | LC aa | human |
| 169 | | HC aa | synthetic |
| 113 | | LC DNA | human |
| 170 | | HC DNA | synthetic |
| 111 | G005-HC-L0-IFNα(A145N) IgG4 | LC aa | human |
| 171 | | HC aa | synthetic |
| 113 | | LC DNA | human |
| 172 | | HC DNA | synthetic |
| 111 | G005-HC-L0-IFNα(A145Q) IgG4 | LC aa | human |
| 173 | | HC aa | synthetic |
| 113 | | LC DNA | human |
| 174 | | HC DNA | synthetic |
| 111 | G005-HC-L0-IFNα(A145R) IgG4 | LC aa | human |
| 175 | | HC aa | synthetic |
| 113 | | LC DNA | human |

| | | | |
|---|---|---|---|
| 176 | | HC DNA | synthetic |
| 111 | G005-HC-L0-IFNα(A145S) IgG4 | LC aa | human |
| 177 | | HC aa | synthetic |
| 113 | | LC DNA | human |
| 178 | | HC DNA | synthetic |
| 111 | G005-HC-L0-IFNα(A145T) IgG4 | LC aa | human |
| 179 | | HC aa | synthetic |
| 113 | | LC DNA | human |
| 180 | | HC DNA | synthetic |
| 111 | G005-HC-L0-IFNα(A145V) IgG4 | LC aa | human |
| 181 | | HC aa | synthetic |
| 113 | | LC DNA | human |
| 182 | | HC DNA | synthetic |
| 111 | G005-HC-L0-IFNα(A145Y) IgG4 | LC aa | human |
| 183 | | HC aa | synthetic |
| 113 | | LC DNA | human |
| 184 | | HC DNA | synthetic |
| 185 | G005-LC-L6-IFNα(A145G) IgG1 | LC aa | synthetic |
| 112 | | HC aa | human |
| 186 | | LC DNA | synthetic |
| 114 | | HC DNA | human |
| 187 | G005-LC-L0-IFNα(A145G) IgG1 | LC aa | synthetic |
| 112 | | HC aa | human |
| 188 | | LC DNA | synthetic |
| 114 | | HC DNA | human |
| 111 | G005-HC-L0-IFNβ IgG4 | LC aa | human |
| 189 | | HC aa | synthetic |
| 113 | | LC DNA | human |
| 190 | | HC DNA | synthetic |
| 111 | G005-HC-L0-IFNβ(R35A) IgG4 | LC aa | human |
| 191 | | HC aa | synthetic |
| 113 | | LC DNA | human |
| 192 | | HC DNA | synthetic |
| 111 | G005-HC-L0-IFNβ(R147A) IgG4 | LC aa | human |
| 193 | | HC aa | synthetic |
| 113 | | LC DNA | human |
| 194 | | HC DNA | synthetic |
| 195 | MORAB03080 IgG1 | LC aa | human |
| 196 | | HC aa | human |
| 197 | | LC DNA | human |
| 198 | | HC DNA | human |
| 199 | hu38SB19 (SAR650984) IgG1 | LC aa | synthetic |
| 200 | | HC aa | synthetic |
| 201 | | LC DNA | synthetic |
| 202 | | HC DNA | synthetic |
| 203 | X355/02 IgG1 | LC aa | human |
| 204 | | HC aa | human |
| 205 | | LC DNA | human |
| 206 | | HC DNA | human |
| 203 | X355/02-HC-L0-IFNα(R144A) IgG4 | LC aa | human |
| 207 | | HC aa | synthetic |
| 205 | | LC DNA | human |
| 208 | | HC DNA | synthetic |
| 203 | X355/02-HC-L0-IFNα(A145D) IgG4 | LC aa | human |
| 209 | | HC aa | synthetic |
| 205 | | LC DNA | human |
| 210 | | HC DNA | synthetic |
| 211 | X355/07 IgG | LC aa | human |
| 212 | | HC aa | human |
| 213 | | LC DNA | human |
| 214 | | HC DNA | human |
| 211 | X355/07-HC-L0-IFNα(R144A) IgG4 | LC aa | human |
| 215 | | HC aa | synthetic |
| 213 | | LC DNA | human |
| 216 | | HC DNA | synthetic |
| 211 | X355/07-HC-L0-IFNα(A145D) IgG4 | LC aa | human |
| 217 | | HC aa | synthetic |
| 213 | | LC DNA | human |
| 218 | | HC DNA | synthetic |
| 219 | X910/12 IgG1 | LC aa | human |
| 220 | | HC aa | human |
| 221 | | LC DNA | human |
| 222 | | HC DNA | human |
| 219 | X910/12-HC-L0-IFNα(R144A) IgG4 | LC aa | human |
| 223 | | HC aa | synthetic |
| 221 | | LC DNA | human |
| 224 | | HC DNA | synthetic |
| 219 | X910/12-HC-L0-IFNα(A145D) IgG4 | LC aa | human |
| 225 | | HC aa | synthetic |

-continued

| | | | |
|---|---|---|---|
| 221 | | LC DNA | human |
| 226 | | HC DNA | synthetic |
| 227 | X913/15 IgG1 | LC aa | human |
| 228 | | HC aa | human |
| 229 | | LC DNA | human |
| 230 | | HC DNA | human |
| 227 | X913/15-HC-L0-IFNα(R144A) IgG4 | LC aa | human |
| 231 | | HC aa | synthetic |
| 229 | | LC DNA | human |
| 232 | | HC DNA | synthetic |
| 227 | X913/15-HC-L0-IFNα(A145D) IgG4 | LC aa | human |
| 233 | | HC aa | synthetic |
| 229 | | LC DNA | human |
| 234 | | HC DNA | synthetic |
| 235 | R5D1 IgG1 | LC aa | synthetic |
| 236 | | HC aa | synthetic |
| 237 | | LC DNA | synthetic |
| 238 | | HC DNA | synthetic |
| 235 | R5D1-HC-L0-IFNα(A145D) IgG4 | LC aa | synthetic |
| 239 | | HC aa | synthetic |
| 237 | | LC DNA | synthetic |
| 240 | | HC DNA | synthetic |
| 241 | R5E8 IgG1 | LC aa | synthetic |
| 242 | | HC aa | synthetic |
| 243 | | LC DNA | synthetic |
| 244 | | HC DNA | synthetic |
| 241 | R5E8-HC-L0-IFNα(A145D) IgG4 | LC aa | synthetic |
| 245 | | HC aa | synthetic |
| 243 | | LC DNA | synthetic |
| 246 | | HC DNA | synthetic |
| 247 | R10A2 IgG1 | LC aa | synthetic |
| 248 | | HC aa | synthetic |
| 249 | | LC DNA | synthetic |
| 250 | | HC DNA | synthetic |
| 247 | R10A2-HC-L0-IFNα(A145D) IgG4 | LC aa | synthetic |
| 251 | | HC aa | synthetic |
| 249 | | LC DNA | synthetic |
| 252 | | HC DNA | synthetic |
| 253 | Rituximab | LC aa | synthetic |
| 254 | | HC aa | synthetic |
| 255 | | LC DNA | synthetic |
| 256 | | HC DNA | synthetic |
| 253 | Rituximab-HC-L6-IFNα IgG1 | LC aa | synthetic |
| 257 | | HC aa | synthetic |
| 255 | | LC DNA | synthetic |
| 258 | | HC DNA | synthetic |
| 253 | Rituximab-HC-L6-IFNα(R144A) IgG1 | LC aa | synthetic |
| 259 | | HC aa | synthetic |
| 255 | | LC DNA | synthetic |
| 260 | | HC DNA | synthetic |
| 253 | Rituximab-HC-L6-IFNα(A145G) IgG1 | LC aa | synthetic |
| 261 | | HC aa | synthetic |
| 255 | | LC DNA | synthetic |
| 262 | | HC DNA | synthetic |
| 253 | Rituximab-HC-L6-IFNα(R33A + YNS) IgG1 | LC aa | synthetic |
| 263 | | HC aa | synthetic |
| 255 | | LC DNA | synthetic |
| 264 | | HC DNA | synthetic |
| 253 | Rituximab-HC-L6-IFNα(R144A + YNS) IgG1 | LC aa | synthetic |
| 265 | | HC aa | synthetic |
| 255 | | LC DNA | synthetic |
| 266 | | HC DNA | synthetic |
| 253 | Rituximab-HC-L6-IFNα(R144A) IgG1 | LC aa | synthetic |
| 393 | | HC aa | synthetic |
| 255 | | LC DNA | synthetic |
| 394 | | HC DNA | synthetic |
| 267 | Palivizumab | LC aa | synthetic |
| 268 | | HC aa | synthetic |
| 269 | | LC DNA | synthetic |
| 270 | | HC DNA | synthetic |
| 267 | Palivizumab-HC-L6-IFNα IgG1 | LC aa | synthetic |
| 271 | | HC aa | synthetic |
| 269 | | LC DNA | synthetic |
| 272 | | HC DNA | synthetic |
| 267 | Palivizumab-HC-L6-IFNα Fab | LC aa | synthetic |
| 273 | | HC aa | synthetic |
| 269 | | LC DNA | synthetic |
| 274 | | HC DNA | synthetic |

-continued

| | | | |
|---|---|---|---|
| 267 | Palivizumab-HC-L6-IFNα(A145D) Fab | LC aa | synthetic |
| 275 | | HC aa | synthetic |
| 269 | | LC DNA | synthetic |
| 276 | | HC DNA | synthetic |
| 277 | J110 IgG1 | LC aa | synthetic |
| 278 | | HC aa | synthetic |
| 279 | | LC DNA | synthetic |
| 280 | | HC DNA | synthetic |
| 281 | HB95 IgG1 | LC aa | synthetic |
| 282 | | HC aa | synthetic |
| 283 | | LC DNA | synthetic |
| 284 | | HC DNA | synthetic |
| 281 | HB95-HC-L0-IFNα(A145D) IgG4 | LC aa | synthetic |
| 285 | | HC aa | synthetic |
| 283 | | LC DNA | synthetic |
| 286 | | HC DNA | synthetic |
| 281 | HB95-HC-L6-IFNα Fab | LC aa | synthetic |
| 287 | | HC aa | synthetic |
| 283 | | LC DNA | synthetic |
| 288 | | HC DNA | synthetic |
| 281 | HB95-HC-L6-IFNα(A145D) Fab | LC aa | synthetic |
| 289 | | HC aa | synthetic |
| 283 | | LC DNA | synthetic |
| 290 | | HC DNA | synthetic |
| 281 | HB95-HC-L16-IL-6 IgG1 | LC aa | synthetic |
| 291 | | HC aa | synthetic |
| 283 | | LC DNA | synthetic |
| 292 | | HC DNA | synthetic |
| 281 | HB95-HC-L16-IL-6(R179E) IgG1 | LC aa | synthetic |
| 293 | | HC aa | synthetic |
| 283 | | LC DNA | synthetic |
| 294 | | HC DNA | synthetic |
| 295 | nBT062 IgG1 | LC aa | synthetic |
| 296 | | HC aa | synthetic |
| 297 | | LC DNA | synthetic |
| 298 | | HC DNA | synthetic |
| 295 | nBT062-HC-L0-IFNα(A145D) IgG4 | LC aa | synthetic |
| 299 | | HC aa | synthetic |
| 297 | | LC DNA | synthetic |
| 300 | | HC DNA | synthetic |
| 301 | C21 IgG1 | LC aa | synthetic |
| 302 | | HC aa | synthetic |
| 303 | | LC DNA | synthetic |
| 304 | | HC DNA | synthetic |
| 301 | C21-HC-L0-IFNα(A145D) IgG4 | LC aa | synthetic |
| 305 | | HC aa | synthetic |
| 303 | | LC DNA | synthetic |
| 306 | | HC DNA | synthetic |
| 307 | 7.1 IgG1 | LC aa | synthetic |
| 308 | | HC aa | synthetic |
| 309 | | LC DNA | synthetic |
| 310 | | HC DNA | synthetic |
| 307 | 7.1-HC-L0-IFNα(A145D) IgG4 | LC aa | synthetic |
| 311 | | HC aa | synthetic |
| 309 | | LC DNA | synthetic |
| 312 | | HC DNA | synthetic |
| 313 | 2D12 IgG1 | LC aa | synthetic |
| 314 | | HC aa | synthetic |
| 315 | | LC DNA | synthetic |
| 316 | | HC DNA | synthetic |
| 313 | 2D12-HC-L6-IFNα(A145G) IgG1 | LC aa | synthetic |
| 317 | | HC aa | synthetic |
| 315 | | LC DNA | synthetic |
| 318 | | HC DNA | synthetic |
| 313 | 2D12-HC-L6-IFNα(A145G) IgG4 | LC aa | synthetic |
| 319 | | HC aa | synthetic |
| 315 | | LC DNA | synthetic |
| 320 | | HC DNA | synthetic |
| 313 | 2D12-HC-L0-IFNα(A145D) IgG4 | LC aa | synthetic |
| 321 | | HC aa | synthetic |
| 315 | | LC DNA | synthetic |
| 322 | | HC DNA | synthetic |
| 313 | 2D12-HC-L6-IFNα Fab | LC aa | synthetic |
| 323 | | HC aa | synthetic |
| 315 | | LC DNA | synthetic |
| 324 | | HC DNA | synthetic |

-continued

| | | | | |
|---|---|---|---|---|
| 313 | 2D12-HC-L6-IFNα(A145D) Fab | | LC aa | synthetic |
| 325 | | | HC aa | synthetic |
| 315 | | | LC DNA | synthetic |
| 326 | | | HC DNA | synthetic |
| 327 | X355/01 IgG1 | | LC aa | human |
| 328 | | | HC aa | human |
| 329 | | | LC DNA | human |
| 330 | | | HC DNA | human |
| 331 | X355/04 IgG1 | | LC aa | human |
| 332 | | | HC aa | human |
| 333 | | | LC DNA | human |
| 334 | | | HC DNA | human |
| 335 | R10B10 IgG1 | | LC aa | synthetic |
| 336 | | | HC aa | synthetic |
| 337 | R7H11 IgG1 | | LC aa | synthetic |
| 338 | | | HC aa | synthetic |
| 339 | R7F11 IgG1 | | LC aa | synthetic |
| 340 | | | HC aa | synthetic |
| 253 | Rituximab-HC-L6-IFNα(R33A) IgG1 | | LC aa | synthetic |
| 393 | | | HC aa | synthetic |
| 255 | | | LC DNA | synthetic |
| 394 | | | HC DNA | synthetic |

| SEQ ID NO: | Clone | Antigen | Chain | Species |
|---|---|---|---|---|
| 341 | G005 | CD38 | Vκ | human |
| 342 | G005 | CD38 | VH | human |
| 343 | MORAB03080 | CD38 | Vλ | human |
| 344 | MORAB03080 | CD38 | VH | human |
| 345 | hu38SB19 (SAR650984) | CD38 | Vκ | synthetic |
| 346 | hu38SB19 (SAR650984) | CD38 | VH | synthetic |
| 347 | X355/02 | CD38 | Vλ | human |
| 348 | X355/02 | CD38 | VH | human |
| 349 | X355/07 | CD38 | Vκ | human |
| 350 | X355/07 | CD38 | VH | human |
| 351 | X910/12 | CD38 | Vλ | human |
| 352 | X910/12 | CD38 | VH | human |
| 353 | X913/15 | CD38 | Vλ | human |
| 354 | X913/15 | CD38 | VH | human |
| 355 | R5D1 | CD38 | Vκ | rat |
| 356 | R5D1 | CD38 | VH | rat |
| 357 | R5E8 | CD38 | Vκ | rat |
| 358 | R5E8 | CD38 | VH | rat |
| 359 | R10A2 | CD38 | Vκ | rat |
| 360 | R10A2 | CD38 | VH | rat |
| 361 | Rituximab | CD20 | Vκ | mouse |
| 362 | Rituximab | CD20 | VH | mouse |
| 363 | Palivizumab | Respiratory Syncytial Virus (RSV) | Vκ | synthetic |
| 364 | Palivizumab | RSV | VH | synthetic |
| 365 | J110 | PD-1 | Vκ | mouse |
| 366 | J110 | PD-1 | VH | mouse |
| 367 | HB95 | HLA | Vκ | mouse |
| 368 | HB95 | HLA | VH | mouse |
| 369 | nBT062 | CD138 | Vκ | mouse |
| 370 | nBT062 | CD138 | VH | mouse |
| 371 | C21 | High Molecular Weight Melanoma-Associated Antigen (HMW-MAA) | Vλ | synthetic |
| 372 | C21 | HMW-MAA | VH | synthetic |
| 373 | 7.1 | HMW-MAA | Vκ | mouse |
| 374 | 7.1 | HMW-MAA | VH | mouse |
| 375 | 2D12 | Yellow Fever Virus (YFV) | Vκ | mouse |
| 376 | 2D12 | YFV | VH | mouse |
| 377 | X355/01 | CD38 | Vκ | human |
| 378 | X355/01 | CD38 | VH | human |
| 379 | X355/04 | CD38 | Vκ | human |
| 380 | X355/04 | CD38 | VH | human |
| 381 | R10B10 | CD38 | Vλ | rat |
| 382 | R10B10 | CD38 | VH | rat |
| 383 | R7H11 | CD38 | Vλ | rat |

-continued

| | | | | | |
|---|---|---|---|---|---|
| 384 | R7H11 | CD38 | | VH | rat |
| 385 | R7F11 | CD38 | | Vκ | rat |
| 386 | R7F11 | CD38 | | VH | rat |

| SEQ ID NO: | Species | Gene |
|---|---|---|
| 387 | human | CD20 |
| 388 | human | PD-1 |
| 389 | human | CD138 |
| 390 | human | High Molecular Weight Melanoma-Associated Antigen (HMW-MAA) |
| 391 | human | IFNα2c |
| 392 | human | IFNα4a |

| SEQ ID NO: | Molecule |
|---|---|
| 395 | Human interferon alpha-2-b with mutation at amino acid position 106 |
| 396 | Human Interferon alpha-2-b with deletion of amino acid at position 106 |
| 397 | Aglycosylated (T106A) human interferon alpha-2-b comprising attenuating mutation L15A |
| 398 | Aglycosylated (T106A) human interferon alpha-2-b comprising attenuating mutation A19W |
| 399 | Aglycosylated (T106A) human interferon alpha-2-b comprising attenuating mutation R22A |
| 400 | Aglycosylated (T106A) human interferon alpha-2-b comprising attenuating mutation R23A |
| 401 | Aglycosylated (T106A) human interferon alpha-2-b comprising attenuating mutation S25A |
| 402 | Aglycosylated (T106A) human interferon alpha-2-b comprising attenuating mutation L26A |
| 403 | Aglycosylated (T106A) human interferon alpha-2-b comprising attenuating mutation F27A |
| 404 | Aglycosylated (T106A) human interferon alpha-2-b comprising attenuating mutation L30X, where X can be any amino acid selected from A, V |
| 405 | Aglycosylated (T106A) human interferon alpha-2-b comprising attenuating mutation K31A |
| 406 | Aglycosylated (T106A) human interferon alpha-2-b comprising attenuating mutation D32A |
| 407 | Aglycosylated (T106A) human interferon alpha-2-b comprising attenuating mutation R33X, where X can be any amino acid selected from K, A, Q |
| 408 | Aglycosylated (T106A) human interferon alpha-2-b comprising attenuating mutation H34A |
| 409 | Aglycosylated (T106A) human interferon alpha-2-b comprising attenuating mutation Q40A |
| 410 | Aglycosylated (T106A) human interferon alpha-2-b comprising attenuating mutation D114R |
| 411 | Aglycosylated (T106A) human interferon alpha-2-b comprising attenuating mutation L117A |
| 412 | Aglycosylated (T106A) human interferon alpha-2-b comprising attenuating mutation R120X where X can be any amino acid selected from A, E |
| 413 | Aglycosylated (T106A) human interferon alpha-2-b comprising attenuating mutation R125X where X can be any amino acid selected from A, E |
| 414 | Aglycosylated (T106A) human interferon alpha-2-b comprising attenuating mutation K131A |
| 415 | Aglycosylated (T106A) human interferon alpha-2-b comprising attenuating mutation E132A |
| 416 | Aglycosylated (T106A) human interferon alpha-2-b comprising attenuating mutation K133A |
| 417 | Aglycosylated (T106A) human interferon alpha-2-b comprising attenuating mutation K134A |
| 418 | Aglycosylated (T106A) human interferon alpha-2-b comprising attenuating mutation R144X where X can be any amino acid selected from A, D, E, G, H, I, K, L, N, Q, S, T, V, Y |
| 419 | Aglycosylated (T106A) human interferon alpha-2-b comprising attenuating mutation A145X where X can be any amino acid selected from D, E, G, H, I, K, L, M, N, Q, R, S, T, V, Y |
| 420 | Aglycosylated (T106A) human interferon alpha-2-b comprising attenuating mutation M148A |
| 421 | Aglycosylated (T106A) human interferon alpha-2-b comprising attenuating mutation R149A |

| | |
|---|---|
| 422 | Aglycosylated (T106A) human interferon alpha-2-b comprising attenuating mutation S152A |
| 423 | Aglycosylated (T106A) human interferon alpha-2-b comprising attenuating mutation L153A |
| 424 | Aglycosylated (T106A) human interferon alpha-2-b comprising attenuating mutation N156A |
| 425 | A10.21 IgG4 (S228P) IFN (A592D, T553X) where X can be any amino acid selected from A, G, E, S, V |
| 426 | Aglycosylated (T106A) human interferon alpha-2-b comprising attenuating mutations L30A, H57Y, E58N and Q61S |
| 427 | Aglycosylated (T106A) human interferon alpha-2-b comprising attenuating mutations R33A, H57Y, E58N and Q61S |
| 428 | Aglycosylated (T106A) human interferon alpha-2-b comprising attenuating mutations Ml48A, H57Y, E58N and Q61S |
| 429 | Aglycosylated (T106A) human interferon alpha-2-b comprising attenuating mutations L153A, H57Y, E58N and Q61S |
| 430 | Aglycosylated (T106A) human interferon alpha-2-b comprising attenuating mutations R144A, H57Y, E58N and Q61S |
| 431 | Aglycosylated (T106A) human interferon alpha-2-b comprising attenuating mutations N65A, L80A, Y85A, Y89A |
| 432 | Aglycosylated (T106A) human interferon alpha-2-b comprising attenuating mutations N65A, L80A, Y85A, Y89A and D114A |
| 433 | Aglycosylated (T106A) human interferon alpha-2-b comprising attenuating mutations N65A, L80A, Y85A, Y89A and L117A |
| 434 | Aglycosylated (T106A) human interferon alpha-2-b comprising attenuating mutations N65A, L80A, Y85A, Y89A and R120A |
| 435 | Aglycosylated (T106A) human interferon alpha-2-b comprising attenuating mutations Y85A, Y89A and R120A |
| 436 | Aglycosylated (T106A) human interferon alpha-2-b comprising attenuating mutations D114A, R120A |
| 437 | Aglycosylated (T106A) human interferon alpha-2-b comprising attenuating mutations L117A, R120A |
| 438 | Aglycosylated (T106A) human interferon alpha-2-b comprising attenuating mutations L117A, R120A, K121A |
| 439 | Aglycosylated (T106A) human interferon alpha-2-b comprising attenuating mutations R120A, K121A |
| 440 | Aglycosylated (T106A) human interferon alpha-2-b comprising attenuating mutations R120E, K121E |
| 441 | Aglycosylated (T106A) human interferon alpha-2-b comprising attenuating deletion of residues L161-E165 |
| 442 | VH sequence of 10.21 (anti-CD38) formatted as IgG4 incorporating hinge stabilisation substitution S228P |
| 443 | VH sequence of 10.21 formatted as an IgG4 incorporating hinge stabilisation substitution S228P and YTE residues substituted in positions 252, 254, 256 respectively |
| 444 | VH sequence of 10.21 formatted as an IgG1 |
| 445 | VH sequence of 10.21 formatted as an IgG1 incorporating substitutions L238A and G240A to reduce effector function |
| 446 | VH sequence of 10.21 formatted as an IgG1 incorporating substitutions L235A and G237A (reduce effector function) and M255Y, S257T, T259E |
| 447 | VH sequence of 10.21 formatted onto an IgG2 backbone |
| 448 | VH sequence of 10.21 formatted onto an IgG2 backbone incorporating substitutions M251Y, S253T and T255E |
| 449 | VH sequence of 10.43 formatted onto an IgG4 backbone incorporating the hinge stabilisation substitution S228P |
| 450 | VH sequence of 10.152 formatted as an IgG4 incorporating the hinge stabilisation substitution S228P |
| 451 | X2.12 VH sequence formatted as an IgG4 (S228P) |
| 452 | Anti-CD138 VH sequence formatted onto an IgG4 (S228P) backbone |
| 453 | Anti-HLA VH sequence formatted onto IgG4 incorporating the hinge stabilising substitution S228P |
| 454 | A10.21VH sequence formatted onto IgG4 backbone incorporating hinge stabilisation subsitution S228P and the deletion of Threonine residue at position 553 (ie: T106 in interferon sequence) |
| 455 | A10.21 IgG4 IFNa2b |
| 456 | A10.21 IgG4 IFNa2b |
| 457 | A10.21 IgG4 IFNa2b |

-continued

| | |
|---|---|
| 458 | A10.21 IgG4 IFNa2b |
| 459 | A10.21 IgG4 IFNa2b |
| 460 | A10.21 IgG4 IFNa2b |
| 461 | A10.21 IgG1 IFNa2b |
| 462 | A10.21 IgG1 IFNa2b |
| 463 | A10.21 IgG1 IFNa2b |
| 464 | A10.21 IgG1 IFNa2b |
| 465 | A10.21 IgG2 IFNa2b |
| 466 | A10.21 IgG2 IFNa2b |
| 467 | A10.43 IgG4 IFNa2b |
| 468 | R10A2 IgG4 IFNa2b |
| 469 | A10.152 IgG4 IFNa2b |
| 470 | A02.12 IgG4 IFNa2b |
| 471 | Anti-CD138 IgG4 IFNa2b |
| 472 | Anti-HLA IgG4 IFN |
| 473 | A10.21 and A10.43 light chain |
| 474 | R10A2 light chain |
| 475 | A10.21 IgG1 IFN |
| 476 | A02.12 lambda light chain |
| 477 | Anti-CD138 light chain |
| 478 | Anti-HLA light chain |
| 479 | A10.21 IgG4 (S228P) IFN (A145D, T106A) |
| 480 | IFN alpha-2-beta |
| 481 | Polynucleotide of 10.21 as an IgG2 incorporating S228P |
| 482 | Polynucleotide sequence of 10.43 as an IgG4 incorporating S228P |
| 483 | Polynucleotide of 2.12 formatted an an IgG4 incorporating S228P |
| 484 | Polynucleotide of R10A2 formatted as an IgG4 incorporating S228P |
| 485 | Polynucleotide sequence of R10A2 VK |
| 486 | Polynucleotide sequence of VK used to generate antibody 10.21 and antibody 10.43 |
| 487 | Polynucleotide sequence of 10.152 formatted as an IgG4 incorporating S228P |
| 488 | Amino acid sequence of 10.152 light chain |
| 489 | Polynucleotide sequence of 10.152 light chain |
| 490 | Polynucleotide sequence of 2.12 light chain |
| 491 | Polynucleotide sequence of Anti-CD138 kappa light chain |
| 492 | Polynucleotide sequence of Anti-CD138 IgG4 (S228P) |
| 493 | Polynucleotide sequence of Anti-HLA IgG4 (S228P) |
| 494 | Polynucleotide sequence of Anti-HLA VK |
| 495 | Polynucleotide sequence of 10.21 formatted as an IgG1 |
| 496 | Polynucleotide sequence of 10.21 IgG2 |
| 497 | Polynucleotide sequence of 10.21 IgG3 |
| 498 | Glycosylated (T106T) human interferon alpha-2-b comprising attenuating mutation A145X where X can be any amino acid selected from D, E, G, H, I, K, L, M, N, Q, R, S, T, V, Y |
| 499 | Glycosylated (T106T) human interferon alpha-2-b comprising attenuating mutation R144X where X can be any amino acid selected from A, D, E, G, H, I, K, L, N, Q, S, T, V, Y |
| 500 | Glycosylated (T106T) human interferon alpha-2-b comprising attenuating mutation R33X, where X can be any amino acid selected from K, A, Q |
| 501 | Human interferon alpha-2-b comprising with deletion of amino acid at position 106 and comprising attenuating mutation A144X where X, can be any amino acid selected from D, E, G, H, I, K, L, M, N, Q, R, S, T, V, Y |
| 502 | VH sequence of 10.21 formatted as an IgG1 incorporating substitutions M255Y, S257T, T259E |
| 504 | Anti-CD38 VH |
| 505 | Anti-CD38 VL |
| 506 | Anti-CD38 heavy chain (h10A2-hIgG4) |
| 507 | Anti-CD38 light chain |
| 508 | Anti-CD38 heavy chain IFN A145D (h10A2-hIgG4) |
| 509 | Anti-CD 47 light chain |
| 510 | Anti-CD47 heavy chain |
| 511 | Anti-CD38 VH consensus sequence |
| 512 | Anti-CD38 VL consensus sequence |
| 513 | B6.H12 anti-CD47 light chain |
| 514 | B6.H12 anti-CD47 heavy chain |
| 515 | N297A B6.H12 anti-CD47 light chain |
| 516 | N297A B6.H12 anti-CD47 heavy chain |
| 517 | N297A 2A1 anti-CD47 light chain |
| 518 | N297A 2A1 anti-CD47 heavy chain |
| 519 | N297A 5F9 anti-CD47 light chain |
| 520 | N297A 5F9 anti-CD47 heavy chain |

| | |
|---|---|
| 521 | HB95 S228P IgG4 anti-HLA IFNa2b A145D light chain |
| 522 | HB95 S228P IgG4 anti-HLA IFNa2b A145D heavy chain |
| 523 | Anti-CD52 S228P IgG4 IFNa2b A145D light chain |
| 524 | Anti-CD52 S228P IgG4 IFNa2b A145D heavy chain |
| 525 | Anti-CD20 S228P IgG4 IFNa2b A145D light chain |
| 526 | Anti-CD20 S228P IgG4 IFNa2b A145D heavy chain |
| 527 | 16C4 S228P IgG4 anti-CD19 IFNa2b A145D light chain |
| 528 | 16C4 S228P IgG4 anti-CD19 IFNa2b A145D heavy chain |
| 529 | EpAb2 S228P IgG4 anti-EpCAM IFNa2b A145D light chain |
| 530 | EpAb2 S228P IgG4 anti-EpCAM IFNa2b A145D heavy chain |
| 531 | Anti-CD38 N297A IFNa2b A145D heavy chain |
| 532 | Anti-CD38 heavy chain IgG4 S228P IFNa2b T106A A145D |
| 533 | Anti-CD38 light chain |
| 534 | Anti-CD47 heavy chain aglycosylated |
| 535 | Anti-CD47 VL |
| 536 | IFNa2b T106A A145D |
| 537 | Anti-CD52 S228P IgG4 heavy chain |
| 538 | Anti-CD38 VL |

SEQUENCE LISTING (539 sequences)

SEQ ID NO: 1 - protein, 166 aa, Homo sapiens
CDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNVDSILAVKKYFRRITLYLTEKKYSPCAWEVVRAEIMRSLSLSTNLQERLRRKE

SEQ ID NO: 2 - protein, 165 aa, Homo sapiens
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 3 - protein, 165 aa, Homo sapiens [sequence omitted]

SEQ ID NO: 4 - protein, 165 aa, Homo sapiens
CDLPQTHSLGSRRTAMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 5 - protein, 165 aa, Homo sapiens
CDLPQTHSLGSRRTLMLLWQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 6 - protein, 165 aa, Homo sapiens
CDLPQTHSLGSRRTLMLLAQMARISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 7 - protein, 165 aa, Homo sapiens
CDLPQTHSLGSRRTLMLLAQMRAISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 8 - protein, 165 aa, Homo sapiens
CDLPQTHSLGSRRTLMLLAQMRRIALFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 9 - protein, 165 aa, Homo sapiens
CDLPQTHSLGSRRTLMLLAQMRRISAFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 10 - protein, 165 aa, Homo sapiens
CDLPQTHSLGSRRTLMLLAQMRRISLASCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 11 - protein, 165 aa, Homo sapiens
CDLPQTHSLGSRRTLMLLAQMRRISLFSCAKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 12 - protein, 165 aa, Homo sapiens
CDLPQTHSLGSRRTLMLLAQMRRISLFSCVKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 13 - protein, 165 aa, Homo sapiens
CDLPQTHSLGSRRTLMLLAQMRRISLFSCLADRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 14 - protein, 165 aa, Homo sapiens
CDLPQTHSLGSRRTLMLLAQMRRISLFSCLKARHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 15 - protein, 165 aa, Homo sapiens
CDLPQTHSLGSRRTLMLLAQMRRISLFSCLKDKHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 16 - protein, 165 aa, Homo sapiens
CDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 17 - protein, 165 aa, Homo sapiens
CDLPQTHSLGSRRTLMLLAQMRRISLFSCLKDQHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 18 - protein, 165 aa, Homo sapiens
CDLPQTHSLGSRRTLMLLAQMRRISLFSCLKDRADFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 19 - protein, 165 aa, Homo sapiens
CDLPQTHSLGSRRTLMLLAQMRRISLFSCLKDRHDFGFPAEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 20 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKERSILAVRKYFQRITLYLKEKKYSPCAWEVVRAEIMRSFSLSTNLQESLRSKE

SEQ ID NO: 21 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIAAVRKYFQRITLYLKEKKYSPCAWEVVRAEIMRSFSLSTNLQESLRSKE

SEQ ID NO: 22 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVAKYFQRITLYLKEKKYSPCAWEVVRAEIMRSFSLSTNLQESLRSKE

SEQ ID NO: 23 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVEKYFQRITLYLKEKKYSPCAWEVVRAEIMRSFSLSTNLQESLRSKE

SEQ ID NO: 24 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQAITLYLKEKKYSPCAWEVVRAEIMRSFSLSTNLQESLRSKE

SEQ ID NO: 25 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQEITLYLKEKKYSPCAWEVVRAEIMRSFSLSTNLQESLRSKE

SEQ ID NO: 26 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLAEKKYSPCAWEVVRAEIMRSFSLSTNLQESLRSKE

SEQ ID NO: 27 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKAKKYSPCAWEVVRAEIMRSFSLSTNLQESLRSKE

SEQ ID NO: 28 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEAKYSPCAWEVVRAEIMRSFSLSTNLQESLRSKE

SEQ ID NO: 29 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKAYSPCAWEVVRAEIMRSFSLSTNLQESLRSKE

SEQ ID NO: 30 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 31 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVDAEIMRSFSLSTNLQESLRSKE

SEQ ID NO: 32 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVEAEIMRSFSLSTNLQESLRSKE

SEQ ID NO: 33 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVGAEIMRSFSLSTNLQESLRSKE

SEQ ID NO: 34 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVHAEIMRSFSLSTNLQESLRSKE

SEQ ID NO: 35 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVIAEIMRSFSLSTNLQESLRSKE

SEQ ID NO: 36 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVKAEIMRSFSLSTNLQESLRSKE

SEQ ID NO: 37 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVLAEIMRSFSLSTNLQESLRSKE

SEQ ID NO: 38 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVNAEIMRSFSLSTNLQESLRSKE

SEQ ID NO: 39 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVQAEIMRSFSLSTNLQESLRSKE

SEQ ID NO: 40 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVSAEIMRSFSLSTNLQESLRSKE

SEQ ID NO: 41 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVTAEIMRSFSLSTNLQESLRSKE

SEQ ID NO: 42 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVVAEIMRSFSLSTNLQESLRSKE

SEQ ID NO: 43 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVYAEIMRSFSLSTNLQESLRSKE

SEQ ID NO: 44 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 45 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVREEIMRSFSLSTNLQESLRSKE

SEQ ID NO: 46 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 47 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRHEIMRSFSLSTNLQESLRSKE

SEQ ID NO: 48 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRIEIMRSFSLSTNLQESLRSKE

SEQ ID NO: 49 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRKEIMRSFSLSTNLQESLRSKE

SEQ ID NO: 50 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRLEIMRSFSLSTNLQESLRSKE

SEQ ID NO: 51 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRMEIMRSFSLSTNLQESLRSKE

SEQ ID NO: 52 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRNEIMRSFSLSTNLQESLRSKE

SEQ ID NO: 53 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRQEIMRSFSLSTNLQESLRSKE

SEQ ID NO: 54 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRREIMRSFSLSTNLQESLRSKE

SEQ ID NO: 55 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRSEIMRSFSLSTNLQESLRSKE

SEQ ID NO: 56 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRTEIMRSFSLSTNLQESLRSKE

SEQ ID NO: 57 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRVEIMRSFSLSTNLQESLRSKE

SEQ ID NO: 58 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRYEIMRSFSLSTNLQESLRSKE

SEQ ID NO: 59 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIARSFSLSTNLQESLRSKE

SEQ ID NO: 60 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMASFSLSTNLQESLRSKE

SEQ ID NO: 61 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFALSTNLQESLRSKE

SEQ ID NO: 62 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSASTNLQESLRSKE

SEQ ID NO: 63 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTALQESLRSKE

SEQ ID NO: 64 - protein, 165 aa, Homo sapiens
CDLPQTHSLGSRRTLMLLAQMRRISLFSCAKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 65 - protein, 165 aa, Homo sapiens
CDLPQTHSLGSRRTLMLLAQMRRISLFSCLKDAHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 66 - protein, 165 aa, Homo sapiens
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIARSFSLSTNLQESLRSKE

SEQ ID NO: 67 - protein, 165 aa, Homo sapiens
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSASTNLQESLRSKE

SEQ ID NO: 68 - protein, 165 aa, Homo sapiens
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 69 - protein, 165 aa, Homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEDSILAVRKYFQRITLYLKEKKYSPCAWEVVRAEIMRSFSLSTNLQESLRSKE

SEQ ID NO: 70 - protein, 165 aa, Homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEASILAVRKYFQRITLYLKEKKYSPCAWEVVRAEIMRSFSLSTNLQESLRSKE

SEQ ID NO: 71 - protein, 165 aa, Homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEDSIAAVRKYFQRITLYLKEKKYSPCAWEVVRAEIMRSFSLSTNLQESLRSKE

SEQ ID NO: 72 - protein, 165 aa, Homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEDSILAVAKYFQRITLYLKEKKYSPCAWEVVRAEIMRSFSLSTNLQESLRSKE

SEQ ID NO: 73 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFATELAQQLNDLEACVIQGVGVTETPLMKEDSILAVAKYFQRITLYLKEKKYSPCAWEVVRAEIMRSFSLSTNLQESLRSKE

SEQ ID NO: 74 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEASILAVAKYFQRITLYLKEKKYSPCAWEVVRAEIMRSFSLSTNLQESLRSKE

SEQ ID NO: 75 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIAAVAKYFQRITLYLKEKKYSPCAWEVVRAEIMRSFSLSTNLQESLRSKE

SEQ ID NO: 76 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIAAVAAYFQRITLYLKEKKYSPCAWEVVRAEIMRSFSLSTNLQESLRSKE

SEQ ID NO: 77 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVAAYFQRITLYLKEKKYSPCAWEVVRAEIMRSFSLSTNLQESLRSKE

SEQ ID NO: 78 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVEEYFQRITLYLKEKKYSPCAWEVVRAEIMRSFSLSTNLQESLRSKE

SEQ ID NO: 79 - protein, 160 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQES

SEQ ID NO: 80 - protein, 166 aa, Homo sapiens
CDLPQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 81 - protein, 166 aa, Homo sapiens
CDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 82 - protein, 166 aa, Homo sapiens
CDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 83 - protein, 166 aa, Homo sapiens
CDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 84 - protein, 166 aa, Homo sapiens
CDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 85 - protein, 166 aa, Homo sapiens
CDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 86 - protein, 166 aa, Homo sapiens
CDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 87 - protein, 166 aa, Homo sapiens
CNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 88 - protein, 166 aa, Homo sapiens
CDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 89 - protein, 166 aa, Homo sapiens
CDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 90 - protein, 166 aa, Homo sapiens
CDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 91 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 92 - protein, 166 aa, Homo sapiens
MSYNLLGFLQRSSNFQCQKLLWQLNGALEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 93 - protein, 166 aa, Homo sapiens
MSYNLLGFLQRSSNFQCQKLLWQLNGRLEYCLKDTMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 94 - protein, 166 aa, Homo sapiens
MSYNLLGFLQRSSNFQCQKLLWQLNGRLEYCLKDRMNFDIPKEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 95 - protein, 166 aa, Homo sapiens
MSYNLLGFLQRSSNFQCQKLLWQLNGRLEYCLKDRMNFDIPEEIKQLQQFQKENAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 96 - protein, 166 aa, Homo sapiens
MSYNLLGFLQRSSNFQCQKLLWQLNGRLEYCLKDRMNFDIPEEIKQLQQFQKEDAALTIYEILQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 97 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTSWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 98 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLARYYGRILHYLKAKEYSHCAWTIVRVEILRNFYFINRLTGYLRN

SEQ ID NO: 99 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHYAWTIVRVEILRNFYFINRLTGYLRN

SEQ ID NO: 100 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCTWTIVRVEILRNFYFINRLTGYLRN

SEQ ID NO: 101 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVKILRNFYFINRLTGYLRN

SEQ ID NO: 102 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILHNFYFINRLTGYLRN

SEQ ID NO: 103 - protein, 166 aa, Homo sapiens
MSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 104 - protein, 166 aa, Homo sapiens
MSYNLLGFLQRSSNFQSQKLLWQLNGRLEYCLKDAMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 105 - protein, 166 aa, Homo sapiens
MSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVAVEILRNFYFINRLTGYLRN

SEQ ID NO: 106 - protein, 310 aa, Homo sapiens
MSALLILALVGAAVAGLNDIFEAQKIEWHEGSHHHHHHHHGSGSLVPRGSGSVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 107 - protein, 310 aa, Macaca sp.
MSALLILALVGAAVAGLNDIFEAQKIEWHEGSHHHHHHHHGSGSLVPRGSGSLPRWRQQWSGSGTTSRFPETVLARCVKYTEVHPEMRHVDCQSVWDAFKGAFISKYPCNITEEDYQPLVKLGTQTVPCNKTLLWSRIKDLAHQFTQVQRDMFTLEDMLLGYLADDLTWCGEFNTFEINYQSCPDWRKDCSNNPVSVFWKTVSRRFAETACGVVHVMLNGSRSKIFDKNSTFGSVEVHNLQPEKVQALEAWVIHGGREDSRDLCQDPTIKELESIISKRNIRFFCKNIYRPDKFLQCVKNPEDSSCLSGI

SEQ ID NO: 108 - DNA, 774 bp, Homo sapiens
gtgcctaggtggcggcagcagtggtccggccctggcaccaccaagaggttccccgagacagtgctggccagatgcgtgaagtacaccgagatccaccccgagatgaggcacgtggactgccagagcgtgtgggacgccttcaagggcgccttcatcagcaagcacccctgcaacatcaccgaagaggactaccagcccctgatgaagctgggcacccagaccgtgccctgcaacaagatcctgctgtggtccaggatcaaggacctggcccatcagttcacccaggtgcagagggacatgttcaccctggaagataccctgctgggctacctggccgacgacctgacttggtgcggcgagttcaacaccagcaagatcaactaccagagctgccccgactggcggaaggactgcagcaacaaccccgtgtccgtgttctggaaaaccgtgtccagaagattcgccgaggccgcctgcgacgtggtgcacgtgatgctgaacggcagcaggtccaagatcttcgacaagaacagcaccttcggcagcgtggaagtgcacaacctgcagcccgagaaggtgcagaccctggaagcctgggtgatccacggcggcagagaggacagcagggacctgtgccaggaccccaccatcaaagagctggaatccatcatctccaagcggaacatccagttcagctgcaagaacatctacaggcccgacaagttcctgcagtgcgtgaagaaccctgaggacagctcctgcaccagcgagatc

SEQ ID NO: 109 - protein, 258 aa, Homo sapiens
VPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 110 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 111 - protein, 214 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 452 aa, Homo sapiens
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - DNA, 642 bp, Homo sapiens
gaaattgtgttgacacagtctccagccaccctgtctttgtctccaggggaaagagccaccctctcctgcagggccagtcagagtgttagcagctacttggcctggtaccaacagaaacctggccaggctcccaggctcctcatctatgatgcctccaacagggccactggcatcccagccaggttcagtggcagtgggtctgggacagacttcactctcaccatcagcagcctggagcctgaagattttgcagtttattactgtcagcagcgtagcaactggcctccgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 114 - DNA, 1356 bp, Homo sapiens
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 115 - protein, 617 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 116 - DNA, 1851 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 117 - protein, 623 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 118 - DNA, 1869 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 119 - protein, 617 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 120 - DNA, 1851 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 121 - protein, 623 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 122 - DNA, 1869 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 123 - protein, 620 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 124 - DNA, 1860 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 125 - protein, 620 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 126 - DNA, 1860 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 127 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 128 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 129 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 130 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 131 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVDAEIMRSFSLSTNLQESLRSKE

SEQ ID NO: 132 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgatgcagaaatcatgagatctttttctttgtcaacaaacttgcaagaaagtttaagaagtaaggaa

SEQ ID NO: 133 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVEAEIMRSFSLSTNLQESLRSKE

SEQ ID NO: 134 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgaggcagaaatcatgagatctttttctttgtcaacaaacttgcaagaaagtttaagaagtaaggaa

SEQ ID NO: 135 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVGAEIMRSFSLSTNLQESLRSKE

SEQ ID NO: 136 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcggcgcagaaatcatgagatctttttctttgtcaacaaacttgcaagaaagtttaagaagtaaggaa

SEQ ID NO: 137 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVHAEIMRSFSLSTNLQESLRSKE

SEQ ID NO: 138 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtccacgcagaaatcatgagatctttttctttgtcaacaaacttgcaagaaagtttaagaagtaaggaa

SEQ ID NO: 139 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVIAEIMRSFSLSTNLQESLRSKE

SEQ ID NO: 140 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcatcgcagaaatcatgagatctttttctttgtcaacaaacttgcaagaaagtttaagaagtaaggaa

SEQ ID NO: 141 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVKAEIMRSFSLSTNLQESLRSKE

SEQ ID NO: 142 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcaaggcagaaatcatgagatctttttctttgtcaacaaacttgcaagaaagtttaagaagtaaggaa

SEQ ID NO: 143 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVLAEIMRSFSLSTNLQESLRSKE

SEQ ID NO: 144 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcctggcagaaatcatgagatctttttctttgtcaacaaacttgcaagaaagtttaagaagtaaggaa

SEQ ID NO: 145 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVNAEIMRSFSLSTNLQESLRSKE

SEQ ID NO: 146 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcaacgcagaaatcatgagatctttttctttgtcaacaaacttgcaagaaagtttaagaagtaaggaa

SEQ ID NO: 147 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVQAEIMRSFSLSTNLQESLRSKE

SEQ ID NO: 148 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtccaggcagaaatcatgagatctttttctttgtcaacaaacttgcaagaaagtttaagaagtaaggaa

SEQ ID NO: 149 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVSAEIMRSFSLSTNLQESLRSKE

SEQ ID NO: 150 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagcgcagaaatcatgagatctttttctttgtcaacaaacttgcaagaaagtttaagaagtaaggaa

SEQ ID NO: 151 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVTAEIMRSFSLSTNLQESLRSKE

SEQ ID NO: 152 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcaccgcagaaatcatgagatctttttctttgtcaacaaacttgcaagaaagtttaagaagtaaggaa

SEQ ID NO: 153 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVVAEIMRSFSLSTNLQESLRSKE

SEQ ID NO: 154 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgtggcagaaatcatgagatctttttctttgtcaacaaacttgcaagaaagtttaagaagtaaggaa

SEQ ID NO: 155 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVYAEIMRSFSLSTNLQESLRSKE

SEQ ID NO: 156 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtctacgcagaaatcatgagatctttttctttgtcaacaaacttgcaagaaagtttaagaagtaaggaa

SEQ ID NO: 157 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 158 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 159 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVREEIMRSFSLSTNLQESLRSKE

SEQ ID NO: 160 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagaggaaatcatgagatctttttctttgtcaacaaacttgcaagaaagtttaagaagtaaggaa

SEQ ID NO: 161 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 162 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 163 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRHEIMRSFSLSTNLQESLRSKE

SEQ ID NO: 164 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagacacgaaatcatgagatctttttctttgtcaacaaacttgcaagaaagtttaagaagtaaggaa

SEQ ID NO: 165 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRIEIMRSFSLSTNLQESLRSKE

SEQ ID NO: 166 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaatcgaaatcatgagatctttttctttgtcaacaaacttgcaagaaagtttaagaagtaaggaa

SEQ ID NO: 167 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRKEIMRSFSLSTNLQESLRSKE

SEQ ID NO: 168 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaaaggaaatcatgagatctttttctttgtcaacaaacttgcaagaaagtttaagaagtaaggaa

SEQ ID NO: 169 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRLEIMRSFSLSTNLQESLRSKE

SEQ ID NO: 170 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagactggaaatcatgagatctttttctttgtcaacaaacttgcaagaaagtttaagaagtaaggaa

SEQ ID NO: 171 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRNEIMRSFSLSTNLQESLRSKE

SEQ ID NO: 172 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaaacgaaatcatgagatctttttctttgtcaacaaacttgcaagaaagtttaagaagtaaggaa

SEQ ID NO: 173 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRQEIMRSFSLSTNLQESLRSKE

SEQ ID NO: 174 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagacaggaaatcatgagatctttttctttgtcaacaaacttgcaagaaagtttaagaagtaaggaa

SEQ ID NO: 175 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRREIMRSFSLSTNLQESLRSKE

SEQ ID NO: 176 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagacgcgaaatcatgagatctttttctttgtcaacaaacttgcaagaaagtttaagaagtaaggaa

SEQ ID NO: 177 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRSEIMRSFSLSTNLQESLRSKE

SEQ ID NO: 178 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaagcgaaatcatgagatctttttctttgtcaacaaacttgcaagaaagtttaagaagtaaggaa

SEQ ID NO: 179 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRTEIMRSFSLSTNLQESLRSKE

SEQ ID NO: 180 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaaccgaaatcatgagatctttttctttgtcaacaaacttgcaagaaagtttaagaagtaaggaa

SEQ ID NO: 181 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRVEIMRSFSLSTNLQESLRSKE

SEQ ID NO: 182 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagtcgaaatcatgagatctttttctttgtcaacaaacttgcaagaaagtttaagaagtaaggaa

SEQ ID NO: 183 - protein, 614 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRYEIMRSFSLSTNLQESLRSKE

SEQ ID NO: 184 - DNA, 1842 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagatacgaaatcatgagatctttttctttgtcaacaaacttgcaagaaagtttaagaagtaaggaa

SEQ ID NO: 185 - protein, 385 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 186 - DNA, 1155 bp, Artificial Sequence
  Description of Artificial Sequence: Synthetic polynucleotide
gaaattgtgttgacacagtctccagccaccctgtctttgtctccaggggaaagagccaccctctcctgcagggccagtcagagtgttagcagctacttggcctggtaccaacagaaacctggccaggctcccaggctcctcatctatgatgcctccaacagggccactggcatcccagccaggttcagtggcagtgggtctgggacagacttcactctcaccatcagcagcctggagcctgaagattttgcagtttattactgtcagcagcgtagcaactggcctccgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 187 - protein, 379 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 188 - DNA, 1137 bp, Artificial Sequence
  Description of Artificial Sequence: Synthetic polynucleotide
gaaattgtgttgacacagtctccagccaccctgtctttgtctccaggggaaagagccaccctctcctgcagggccagtcagagtgttagcagctacttggcctggtaccaacagaaacctggccaggctcccaggctcctcatctatgatgcctccaacagggccactggcatcccagccaggttcagtggcagtgggtctgggacagacttcactctcaccatcagcagcctggagcctgaagattttgcagtttattactgtcagcagcgtagcaactggcctccgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgttgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 189 - protein, 615 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 190 - DNA, 1845 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaaatgagctacaacctgcttggattcctccaaagaagcagcaattttcagtcccagaagctcctgtggcaactgaatgggaggctcgaatattgcctcaaggacaggatgaactttgacatccctgaggagattaagcagctgcagcagttccagaaggaggacgccgcattgaccatctatgagatgctccagaacatctttgctattttcagacaagattcctctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctgaggaacttttacttcattaacagacttacaggttacctccgaaac

SEQ ID NO: 191 - protein, 615 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMSYNLLGFLQRSSNFQSQKLLWQLNGRLEYCLKDAMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 192 - DNA, 1845 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaaatgagctacaacctgcttggattcctccaaagaagcagcaattttcagtcccagaagctcctgtggcaactgaatgggaggctcgaatattgcctcaaggacgcgatgaactttgacatccctgaggagattaagcagctgcagcagttccagaaggaggacgccgcattgaccatctatgagatgctccagaacatctttgctattttcagacaagattcctctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctgaggaacttttacttcattaacagacttacaggttacctccgaaac

SEQ ID NO: 193 - protein, 615 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVAVEILRNFYFINRLTGYLRN

SEQ ID NO: 194 - DNA, 1845 bp, Artificial Sequence
  Description of Artificial Sequence: Synthetic polynucleotide
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaaatgagctacaacctgcttggattcctccaaagaagcagcaattttcagtcccagaagctcctgtggcaactgaatgggaggctcgaatattgcctcaaggacaggatgaactttgacatccctgaggagattaagcagctgcagcagttccagaaggaggacgccgcattgaccatctatgagatgctccagaacatctttgctattttcagacaagattcctctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcgcagtggaaatcctgaggaacttttacttcattaacagacttacaggttacctccgaaac

SEQ ID NO: 195 - protein, 212 aa, Homo sapiens
DIELTQPPSVSVAPGQTARISCSGDNIGNKYVSWYQQKPGQAPVVVIYGDNNRPSGIPERFSGSNSGNTATLTISGTQAEDEADYYCSSYDSSYFVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 196 - protein, 452 aa, Homo sapiens
QVQLVESGGGLVQPGGSLRLSCAASGFTFSSYGMHWVRQAPGKGLEWVSNIYSDGSNTFYADSVKGRFTISRDNSKNTLYLQMNSLRAEDTAVYYCARNMYRWPFHYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - DNA, 636 bp, Homo sapiens
gatatcgaactgacccagccgccttcagtgagcgttgcaccaggtcagaccgcgcgtatctcctgtagcggcgataatattggtaataagtatgtttcttggtaccagcagaaacccgggcaggcgccagttgttgtgatttatggtgataataatcgtccctcaggcatcccggaacgctttagcggctccaacagcggcaacaccgcgaccctgaccattagcggcactcaggcggaagacgaagcggattattattgctcttcttatgattcttcttattttgtgtttggcggcggcacgaagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 198 - DNA, 1356 bp, Homo sapiens
caggtgcaattggtggaaagcggcggcggcctggtgcaaccgggcggcagcctgcgcctgagctgcgcggcctccgggtttaccttttcttcttatggtatgcactgggtgcgccaagcccctgggaagggtctggagtgggtgagcaatatctattctgatggtagcaataccttttatgcggatagcgtgaaaggccggtttaccatttcaagagataattccaaaaacaccctgtatctgcaaatgaacagcctgagggcggaagatacggccgtgtattattgcgcgagaaatatgtatcgctggccttttcattatttttttgattattggggccaaggcaccctggtgacggttagctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 199 - protein, 214 aa, Artificial Sequence
  Description of Artificial Sequence: Synthetic polypeptide
DIVMTQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 450 aa, Artificial Sequence
  Description of Artificial Sequence: Synthetic polypeptide
QVQLVQSGAEVAKPGTSVKLSCKASGYTFTDYWMQWVKQRPGQGLEWIGTIYPGDGDTGYAQKFQGKATLTADKSSKTVYMHLSSLASEDSAVYYCARGDYYGSNSLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - DNA, 642 bp, Artificial Sequence
  Description of Artificial Sequence: Synthetic polynucleotide
gatatcgtaatgacccagtcccacctgagtatgagtacctccctgggagatcctgtgtcaatcacttgcaaggcctcacaggatgtgagcaccgtcgttgcttggtatcagcagaagcccgggcaatcacccagacgtctcatctactcagcatcataccgttacatcggggtgcctgaccgatttactggctctggcgctggcacagatttcacctttacaattagttccgtccaggccgaagacctggccgtgtactactgccagcagcactacagtcccccatacactttcgggggagggactaagctcgaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 202 - DNA, 1350 bp, Homo sapiens
caggtacagctcgttcagtccggcgccgaggtagctaagcctggtacttccgtaaaattgtcctgtaaggcttccgggtacacatttacagactactggatgcagtgggtaaaacagcggccaggtcagggcctggagtggattggaacaatatatcccggcgacggcgacacaggctatgcccagaagtttcaaggcaaggcaacccttactgctgataaatcttccaagactgtctacatgcacctgtcttccttggcatctgaggatagcgctgtctattactgtgctaggggggactactatgggtcaaattccctggattactggggccagggcaccagtgtcaccgtgagcagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 203 - protein, 222 aa, Homo sapiens
QAVLTQPASLSASPGESARLTCTLPSDINVRYYNIYWYQQKPGSPPRYLLYYYSDSHKGQGSGVPSRFSGSKDVSTNSGILLISGLQSEDEADYYCMTWSSNGSGVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 204 - protein, 451 aa, Homo sapiens
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - DNA, 666 bp, Homo sapiens
caggctgtgctgactcagccggcttccctctctgcatctcctggagaatccgccagactcacctgcaccttgcccagtgacatcaatgttcgttactacaacatatactggtaccagcagaagccagggagccctcccaggtatctcctgtactactactcagactcacataagggccagggctctggagtccccagccgcttctctggatccaaagatgtttcaaccaattcagggattttactcatctccgggctccagtctgaggatgaggctgactattactgtatgacttggtcaagcaatggttctggggtgttcggcggagggacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 206 - DNA, 1353 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 207 - protein, 613 aa, Artificial Sequence
  Description of Artificial Sequence: Synthetic polypeptide
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 208 - DNA, 1839 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 209 - protein, 613 aa, Artificial Sequence
  Description of Artificial Sequence: Synthetic polypeptide
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 210 - DNA, 1839 bp, Homo sapiens
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 211 - protein, 215 aa, Homo sapiens
AIQMTQSPSSLSASVGDRVTITCRASQSISSYLNWYQQKPGKAPKLLIYAASSLQSGVPSRFSGSGSGTDFTLTISSLQPEDFATYYCQQSYFTPLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - protein, 448 aa, Homo sapiens
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - DNA, 645 bp, Homo sapiens
gccatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaaccggaagattttgcaacttactactgtcaacagagttactttacccccctgtacacttttggccaggggaccaagctggagatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 214 - DNA, 1344 bp, Artificial Sequence
  Description of Artificial Sequence: Synthetic polynucleotide
caggtgcagctacaggagtcgggcccaggactggtgaagccttcggagaccctgtccctcacctgcgctgtctatggtgggtccttcagtggttactactggagctggatccgccagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatttgtactactactacggtatggacgtctggggccaagggaccacggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 215 - protein, 610 aa, Artificial Sequence
  Description of Artificial Sequence: Synthetic polypeptide
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 216 - DNA, 1830 bp, Artificial Sequence
  Description of Artificial Sequence: Synthetic polynucleotide
caggtgcagctacaggagtcgggcccaggactggtgaagccttcggagaccctgtccctcacctgcgctgtctatggtgggtccttcagtggttactactggagctggatccgccagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatttgtactactactacggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 217 - protein, 610 aa, Artificial Sequence [sequence omitted]

SEQ ID NO: 218 - DNA, 1830 bp, Homo sapiens
caggtgcagctacaggagtcgggcccaggactggtgaagccttcggagaccctgtccctcacctgcgctgtctatggtgggtccttcagtggttactactggagctggatccgccagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatttgtactactactacggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 219 - protein, 222 aa, Homo sapiens
QAVLTQPASLSASPGESARLTCTLPSDINVRYYNIYWYQQKPGSPPRYLLYYYSDSHKDQGSGVPSRFSGSKDTSANTGILLISGLQSEDEADYYCMIWASNGSGVLGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 220 - protein, 452 aa, Homo sapiens
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - DNA, 666 bp, Homo sapiens
caggctgtgctgactcagccggcttccctctctgcatctcctggagaatccgccagactcacctgcaccttgcccagtgacatcaatgttcgttactacaacatatactggtatcagcagaagccagggagccctcccaggtatctcctatactactactcagactcacataaggaccagggctctggagtccccagccgcttctctggatccaaagatacttcagccaatacagggattttactcatctccgggctccagtctgaggatgaggctgactattactgtatgatttgggcaagcaatggttctggggtgctcggcggaggcacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 222 - DNA, 1356 bp, Artificial Sequence
  Description of Artificial Sequence: Synthetic polynucleotide
gaggtccagctggtacagtctggggctgaggtgaagaagtctggggcctcagtgaaggtctcctgcaaggcttctggatacaccttcaccgactactatatacactgggtgcgacaggcccctggacaagggcttgagtggatgggatggatcaaccctaacaatggtggcgtaacctttgcccagaagtttcagggcagggtcaccatgaccagggacacgtccatcagcacagcctacatggacctgagcagcctgagatctgacgacacggccgtctacttctgtgcgagagatattcgaatgagcgggtggctggcgccatttgactactggggccagggaaccctggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 223 - protein, 614 aa, Artificial Sequence
  Description of Artificial Sequence: Synthetic polypeptide
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 224 - DNA, 1842 bp, Artificial Sequence
  Description of Artificial Sequence: Synthetic polynucleotide
gaggtccagctggtacagtctggggctgaggtgaagaagtctggggcctcagtgaaggtctcctgcaaggcttctggatacaccttcaccgactactatatacactgggtgcgacaggcccctggacaagggcttgagtggatgggatggatcaaccctaacaatggtggcgtaacctttgcccagaagtttcagggcagggtcaccatgaccagggacacgtccatcagcacagcctacatggacctgagcagcctgagatctgacgacacggccgtctacttctgtgcgagagatattcgaatgagcgggtggctggcgccatttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 225 - protein, 614 aa, Artificial Sequence
  Description of Artificial Sequence: Synthetic polypeptide
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 226 - DNA, 1842 bp, Homo sapiens
gaggtccagctggtacagtctggggctgaggtgaagaagtctggggcctcagtgaaggtctcctgcaaggcttctggatacaccttcaccgactactatatacactgggtgcgacaggcccctggacaagggcttgagtggatgggatggatcaaccctaacaatggtggcgtaacctttgcccagaagtttcagggcagggtcaccatgaccagggacacgtccatcagcacagcctacatggacctgagcagcctgagatctgacgacacggccgtctacttctgtgcgagagatattcgaatgagcgggtggctggcgccatttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 227 - protein, 222 aa, Homo sapiens
QAVLTQPASLSASPGESARLTCTLPSDINVRYHNIYWYQEKPGSPPRYLLYYYSDSSKGQGSGVPSRFSGSKDVSTNTGILVISGLQSEDEAEYYCMTWSSNGSGVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 228 - protein, 450 aa, Homo sapiens
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - DNA, 666 bp, Homo sapiens
caggctgtgctgactcagccggcttccctctctgcatctcctggagaatccgccagactcacctgcaccttgcccagtgacatcaatgttcgttaccacaacatatactggtatcaggagaagccagggagtccacccaggtatctcctgtactactactcagactcaagtaagggccagggctctggagtccccagccgcttctctggatccaaagatgtttcaaccaatacagggattttagtcatctccgggctccagtctgaggatgaggctgagtattactgtatgacttggtcaagcaatggttctggggtgttcggcggaggcacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 230 - DNA, 1350 bp, Artificial Sequence
  Description of Artificial Sequence: Synthetic polynucleotide
caggtgcagctggtggagtctgggggaggcgtggtccaggggggggggtccctgagactctcctgtgcagcctctggattcaccgtcagaagcaactacatgagctgggtccgccaggctccagggaaggggctggagtgggtctcagctattagtggtagtggtgatagcacatactatgcagactccgtgaagggccggttcaccatctccagagacaactccaagaatacgttgtatttgcaaatgaacagcctgagagccgaggacacggccgtatattactgtgcgaaagtagcggtgactacaggctggtacttcgatctctggggccgtggcaccctggtcactgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 231 - protein, 612 aa, Artificial Sequence
  Description of Artificial Sequence: Synthetic polypeptide
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 232 - DNA, 1836 bp, Artificial Sequence
  Description of Artificial Sequence: Synthetic polynucleotide
caggtgcagctggtggagtctgggggaggcgtggtccaggggggggggtccctgagactctcctgtgcagcctctggattcaccgtcagaagcaactacatgagctgggtccgccaggctccagggaaggggctggagtgggtctcagctattagtggtagtggtgatagcacatactatgcagactccgtgaagggccggttcaccatctccagagacaactccaagaatacgttgtatttgcaaatgaacagcctgagagccgaggacacggccgtatattactgtgcgaaagtagcggtgactacaggctggtacttcgatctctggggccgtggcaccctggtcactgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 233 - protein, 612 aa, Artificial Sequence
  Description of Artificial Sequence: Synthetic polypeptide
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 234 - DNA, 1836 bp, Artificial Sequence
  Description of Artificial Sequence: Synthetic polynucleotide
caggtgcagctggtggagtctgggggaggcgtggtccaggggggggggtccctgagactctcctgtgcagcctctggattcaccgtcagaagcaactacatgagctgggtccgccaggctccagggaaggggctggagtgggtctcagctattagtggtagtggtgatagcacatactatgcagactccgtgaagggccggttcaccatctccagagacaactccaagaatacgttgtatttgcaaatgaacagcctgagagccgaggacacggccgtatattactgtgcgaaagtagcggtgactacaggctggtacttcgatctctggggccgtggcaccctggtcactgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 235 - protein, 214 aa, Artificial Sequence
  Description of Artificial Sequence: Synthetic polypeptide
DIQMTQSPASLSASLGETVTIECRASEDIYSNLAWYQQKPGNSPQLLIYDANSLADGVPSRFSASGSGTQFSLKINSLRSEDVASYFCQQYNNYPYTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 236 - protein, 450 aa, Artificial Sequence
  Description of Artificial Sequence: Synthetic polypeptide
EVQLQQSGPEVGRPGSSVKISCKASGYTFTDYIMHWVKQSPGQGLEWIGWIDPEYGRTDYAEKFKKKATLTADTSSSTAYIQLSSLASEDTATYFCARSAHTTGFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - DNA, 642 bp, Artificial Sequence
  Description of Artificial Sequence: Synthetic polynucleotide
gacatccagatgacacagtctccagcttccctgtctgcatctctgggagaaactgtcaccatcgaatgtcgagcaagtgaggacatttacagtaatttagcgtggtatcagcagaaaccagggaactctcctcagctcctgatctatgatgcaaatagcttggcagatggggtcccatcacggttcagtgccagtggatctggcacacagttttctctaaagataaacagcctgcgatctgaagatgtcgcaagttatttctgtcaacagtataacaattatccgtacacgtttggagctgggaccaagctggaactgaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 238 - DNA, 1350 bp, Artificial Sequence
  Description of Artificial Sequence: Synthetic polynucleotide
gaagtccagctgcagcagtctgggcctgaggttgggaggcctgggtcctcagtcaagatttcttgcaaggcttctggctacacctttacagattacattatgcactgggtgaagcagagtcctggacaggggctggaatggataggatggattgatcctgagtatggtaggactgattatgctgagaagttcaaaaagaaggccacactgaccgcagatacatcctccagcacagcctacatccagcttagcagcctggcatctgaggacacagccacctatttttgtgctagatcggctcatactacgggatttggatttgcttactggggccaaggcactctggtgacagtgtcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 239 - protein, 612 aa, Artificial Sequence [sequence omitted]

SEQ ID NO: 240 - DNA, 1836 bp, Artificial Sequence
  Description of Artificial Sequence: Synthetic polynucleotide
gaagtccagctgcagcagtctgggcctgaggttgggaggcctgggtcctcagtcaagatttcttgcaaggcttctggctacacctttacagattacattatgcactgggtgaagcagagtcctggacaggggctggaatggataggatggattgatcctgagtatggtaggactgattatgctgagaagttcaaaaagaaggccacactgaccgcagatacatcctccagcacagcctacatccagcttagcagcctggcatctgaggacacagccacctatttttgtgctagatcggctcatactacgggatttggatttgcttactggggccaaggcactctggtgacagtgtcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 241 - protein, 219 aa, Artificial Sequence
  Description of Artificial Sequence: Synthetic polypeptide
DIVMTQGALPNPVPSGESASITCQSSESLLHSNGKTYLNWYLQRPGQSPQLLIYWMSTRAAGVSDRFSGSGSGTDFTLTISGVEAEDVGVYYCQQFLEYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 453 aa, Artificial Sequence
  Description of Artificial Sequence: Synthetic polypeptide
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - DNA, 657 bp, Artificial Sequence
  Description of Artificial Sequence: Synthetic polynucleotide
gatattgtgatgacccagggtgcactccccaatcctgtcccttctggagagtcagcttccatcacctgccagtctagtgagagtctgctgcacagcaatggcaagacatacttgaattggtatctgcagaggccaggacagtctcctcagctcctgatctattggatgtctacccgtgcagcaggagtctcagacaggttcagtggcagtgggtcaggaacagatttcacactgacaatcagtggcgtggaggctgaggatgtgggtgtgtattactgtcagcaatttctagagtatcctcccacgttcggttctgggaccaagctggagatcaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 244 - DNA, 1359 bp, Artificial Sequence
  Description of Artificial Sequence: Synthetic polynucleotide
gaagtccagctgcagcagtctgggcctgaggttgggaggcctgggtcctcagtcaagatttcttgcaaggcttctggctacatctttacagattacattatgcactgggtgaagcagagtcctggacaggggctggaatggataggatggattgatcctgagtatggtagtactgattatgctgagaagttcaaaaagaaggccacactgactgcagatacatcctccagcacagcctacatccagcttagcagcctgacatctgaggacacagccacctatttttgtgctagggtggcgattattactacagtggcctctggggggtttgcttactggggccaaggcactctggtgacagtgtcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 245 - protein, 615 aa, Artificial Sequence
  Description of Artificial Sequence: Synthetic polypeptide
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 246 - DNA, 1845 bp, Artificial Sequence
  Description of Artificial Sequence: Synthetic polynucleotide
gaagtccagctgcagcagtctgggcctgaggttgggaggcctgggtcctcagtcaagatttcttgcaaggcttctggctacatctttacagattacattatgcactgggtgaagcagagtcctggacaggggctggaatggataggatggattgatcctgagtatggtagtactgattatgctgagaagttcaaaaagaaggccacactgactgcagatacatcctccagcacagcctacatccagcttagcagcctgacatctgaggacacagccacctatttttgtgctagggtggcgattattactacagtggcctctggggggtttgcttactggggccaaggcactctggtgacagtgtcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 247 - protein, 214 aa, Artificial Sequence
  Description of Artificial Sequence: Synthetic polypeptide
DIVMTQSPTSISISVGERVTMNCKASQNVDSDVDWYQQKTGQSPKLLIYKASNRYTGVPDRFTGSGSGTDFTFTISNMQAEDLAVYYCMQSNTHPRTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 450 aa, Artificial Sequence
  Description of Artificial Sequence: Synthetic polypeptide
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - DNA, 642 bp, Artificial Sequence
  Description of Artificial Sequence: Synthetic polynucleotide
gacattgtgatgactcagtctcccacatccatttccatatcagtaggagagagggtcaccatgaactgcaaggccagtcagaatgtggattctgatgtagactggtaccaacagaaaacagggcagtctcctaaactgcttatctacaaggcatccaaccggtacactggcgtccctgatcgcttcacaggcagtggatctggaacagatttcactttcaccatcagcaacatgcaggctgaagacctggctgtttattactgtatgcagtctaacacccatcctcggacgttcggtggaggcaccaagctggaattgaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 250 - DNA, 1350 bp, Artificial Sequence
  Description of Artificial Sequence: Synthetic polynucleotide
gaagtccagctgcagcagtctgggcctgaggttgggaggcctgggtcctcagtcaagatttcttgcaaggcttctggctacacctttacagattccgttatgaactgggtgaagcagagtcctggacaggggctggaatggataggatggattgatcctgagtatggtagaactgatgttgctgagaagttcaaaaagaaggccacactgactgcagattcatcctccagcacagcctacatctaccttagtggcctgacatctgaggacacagccacctatttttgtgctaggacaaagtataattcggggtacgggtttccttactggggccaaggctctctggtcactgtctcttcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 251 - protein, 612 aa, Artificial Sequence
  Description of Artificial Sequence: Synthetic polypeptide
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 252 - DNA, 1836 bp, Artificial Sequence
  Description of Artificial Sequence: Synthetic polynucleotide
gaagtccagctgcagcagtctgggcctgaggttgggaggcctgggtcctcagtcaagatttcttgcaaggcttctggctacacctttacagattccgttatgaactgggtgaagcagagtcctggacaggggctggaatggataggatggattgatcctgagtatggtagaactgatgttgctgagaagttcaaaaagaaggccacactgactgcagattcatcctccagcacagcctacatctaccttagtggcctgacatctgaggacacagccacctatttttgtgctaggacaaagtataattcggggtacgggtttccttactggggccaaggctctctggtcactgtctcttcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 253 - protein, 213 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 254 - protein, 451 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - DNA, 639 bp, Artificial Sequence
  Description of Artificial Sequence: Synthetic polynucleotide
caaattgttctctcccagtctccagcaatcctgtctgcatctccaggggagaaggtcacaatgacttgcagggccagctcaagtgtaagttacatccactggttccagcagaagccaggatcctcccccaaaccctggatttatgccacatccaacctggcttctggagtccctgttcgcttcagtggcagtgggtctgggacttcttactctctcacaatcagcagagtggaggctgaagatgctgccacttattactgccagcagtggactagtaacccacccacgttcggaggggggaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 256 - DNA, 1353 bp, Artificial Sequence
  Description of Artificial Sequence: Synthetic polynucleotide
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 257 - protein, 622 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 258 - DNA, 1865 bp, Artificial Sequence
  Description of Artificial Sequence: Synthetic polynucleotide
aggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 259 - protein, 622 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 260 - DNA, 1860 bp, Artificial Sequence
  Description of Artificial Sequence: Synthetic polynucleotide
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagt

SEQ ID NO: 261 - protein, 622 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 262 - DNA, 1866 bp, Artificial Sequence
  Description of Artificial Sequence: Synthetic polynucleotide
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 263 - protein, 622 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDAHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 264 - DNA, 1866 bp, Artificial Sequence
  Description of Artificial Sequence: Synthetic polynucleotide
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacgcacatgactttggatttccccaggaggagtttggcaaccagttccaaaaggctgaaaccatccctgtcctctataacatgatcagccagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 265 - protein, 622 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 266 - DNA, 1866 bp, Artificial Sequence
  Description of Artificial Sequence: Synthetic polynucleotide
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctctataacatgatcagccagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 267 - protein, 213 aa, Artificial Sequence
  Description of Artificial Sequence: Synthetic polypeptide
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - protein, 450 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - DNA, 639 bp, Artificial Sequence
  Description of Artificial Sequence: Synthetic polynucleotide
gatatccagatgacccagtctccttccaccctgtctgcatctgtgggagacagagtcaccatcacttgcaagtgccagctgagcgtgggctacatgcactggtatcagcagaaaccagggaaagcccctaagctcctgatctatgacacaagcaaattggcatctggggtcccatcaaggttcagcggcagtggatctgggacagaatttactctcaccatcagcagcctgcagcctgatgatttcgcaacttattactgcttccagggttccgggtatccgtttacgttcggaggggggaccaagctcgaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 270 - DNA, 1350 bp, Artificial Sequence
  Description of Artificial Sequence: Synthetic polynucleotide
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 271 - protein, 621 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 272 - DNA, 1863 bp, Artificial Sequence
  Description of Artificial Sequence: Synthetic polynucleotide
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 273 - protein, 394 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 274 - DNA, 1182 bp, Artificial Sequence
  Description of Artificial Sequence: Synthetic polynucleotide
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 275 - protein, 394 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 276 - DNA, 1182 bp, Artificial Sequence
  Description of Artificial Sequence: Synthetic polynucleotide
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 277 - protein, 214 aa, Artificial Sequence
  Description of Artificial Sequence: Synthetic polypeptide
DIQMTQSPASLSASVGETVTLTCRASENIHNYLAWYQQKQGKSPQLLVYNVKTLADGVPSRFSGSGSGTQYSLKINSLQPEDFGSYYCQHFWSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 449 aa, Artificial Sequence
  Description of Artificial Sequence: Synthetic polypeptide
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 279 - DNA, 642 bp, Artificial Sequence
  Description of Artificial Sequence: Synthetic polynucleotide
gacatccagatgactcagtctccagcctccctatctgcatctgtgggagaaactgtcaccctcacatgtcgagcaagtgagaatattcacaattatttagcatggtatcagcagaaacagggaaaatctcctcagctcctggtctataatgtaaaaaccttagcagatggtgtgccatcaaggttcagtggcagtggatcaggaacacaatattctctcaagatcaacagcctgcagcctgaagattttgggagttattactgtcaacatttttggagtagtccgtggacgttcggtggaggcaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 280 - DNA, 1347 bp, Artificial Sequence
  Description of Artificial Sequence: Synthetic polynucleotide
gatgtgcagcttcaggagtcgggacctggcctggtgaaaccttctcagtctctgtccctcacctgcactgtcactggccactcaatcaccagtgattatgcctggaactggatccggcagtttccaggagacaaactggagtggatgggctacataagctacagtggttacactacctacaacccatctctgaaaagtcgagtctctatcactcgagacacatccaagaaccagttcttcctgcagttgaattctgtgactactgaggacacagccacatacttctgtgcaagagaccttgattacggcccctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 281 - protein, 215 aa, Artificial Sequence
  Description of Artificial Sequence: Synthetic polypeptide
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPWTFGGGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 450 aa, Artificial Sequence
  Description of Artificial Sequence: Synthetic polypeptide
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - DNA, 645 bp, Artificial Sequence
  Description of Artificial Sequence: Synthetic polynucleotide
agtattgtgatgacccagactcccaaattcctgcttgtatcagcaggagacagggttaccataacctgcaaggccagtcagagtgtgagtaatgatgtagcttggtaccaacagaagccagggcagtctcctaaactgcttatatattatgcatccaatcgctacactggagtccctgatcgcttcactggcagtggatatgggacggatttcactttcaccatcagcactgtgcaggctgaagacctggcagtttatttctgtcagcaggattatagctctcctccgtggacgttcggtggaggcaccaagctggaaatcagacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 284 - DNA, 1350 bp, Artificial Sequence
  Description of Artificial Sequence: Synthetic polynucleotide
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 285 - protein, 612 aa, Artificial Sequence
  Description of Artificial Sequence: Synthetic polypeptide
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 286 - DNA, 1836 bp, Artificial Sequence
  Description of Artificial Sequence: Synthetic polynucleotide
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 287 - protein, 394 aa, Artificial Sequence
  Description of Artificial Sequence: Synthetic polypeptide
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 288 - DNA, 1182 bp, Artificial Sequence
  Description of Artificial Sequence: Synthetic polynucleotide
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 289 - protein, 393 aa, Artificial Sequence
  Description of Artificial Sequence: Synthetic polypeptide
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSK

SEQ ID NO: 290 - DNA, 1182 bp, Artificial Sequence
  Description of Artificial Sequence: Synthetic polynucleotide
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 291 - protein, 650 aa, Artificial Sequence
  Description of Artificial Sequence: Synthetic polypeptide
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 292 - DNA, 1950 bp, Artificial Sequence
  Description of Artificial Sequence: Synthetic polynucleotide
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatg

SEQ ID NO: 293 - protein, 644 aa, Artificial Sequence
  Description of Artificial Sequence: Synthetic polypeptide
SGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLEALRQM

SEQ ID NO: 294 - DNA, 1950 bp, Artificial Sequence
  Description of Artificial Sequence: Synthetic polynucleotide
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctggaggctcttcggcaaatg

SEQ ID NO: 295 - protein, 214 aa, Artificial Sequence
  Description of Artificial Sequence: Synthetic polypeptide
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 452 aa, Artificial Sequence
  Description of Artificial Sequence: Synthetic polypeptide
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - DNA, 642 bp, Artificial Sequence
  Description of Artificial Sequence: Synthetic polynucleotide
gacatccagatgacccagagcacatcctctctgagcgcctccctgggcgatcgcgtgactatcagttgcagcgcttcccaagggattaacaattacctcaactggtaccagcagaagcccgacggaaccgtcgagctgctcatctattacacatctacgctgcaaagcggcgtgccttccaggttctcagggagcggttccggaactgattactctctgaccattagcaatctcgaaccagaagacatcggcacatattactgtcagcagtactccaagctgccccggacttttgggggaggcaccaaactggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 298 - DNA, 1356 bp, Artificial Sequence
  Description of Artificial Sequence: Synthetic polynucleotide
caggtgcagctccaacagagcggctccgaactgatgatgcctggggcctctgtcaagatttcctgcaaagctaccggctacacattcagcaactattggattgagtgggtgaagcagcgcccagggcacggtctggagtggatcggagagatcctgccaggcaccgggaggactatttacaatgaaaagtttaaaggaaaggccacattcaccgcagacatctctagcaacactgttcaaatgcagctctcctctctgacctccgaggatagcgccgtgtattactgtgctcggagagactactatggcaatttttactatgctatggattactggggacagggcacatctgtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 299 - protein, 614 aa, Artificial Sequence
  Description of Artificial Sequence: Synthetic polypeptide
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 300 - DNA, 1842 bp, Artificial Sequence
  Description of Artificial Sequence: Synthetic polynucleotide
caggtgcagctccaacagagcggctccgaactgatgatgcctggggcctctgtcaagatttcctgcaaagctaccggctacacattcagcaactattggattgagtgggtgaagcagcgcccagggcacggtctggagtggatcggagagatcctgccaggcaccgggaggactatttacaatgaaaagtttaaaggaaaggccacattcaccgcagacatctctagcaacactgttcaaatgcagctctcctctctgacctccgaggatagcgccgtgtattactgtgctcggagagactactatggcaatttttactatgctatggattactggggacagggcacatctgtgaccgtcagctccgctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 301 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 302 - protein, 448 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSDDTAVYYCARALDPITFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - DNA, 642 bp, Artificial Sequence
  Description of Artificial Sequence: Synthetic polynucleotide
tctagcgagctgacccaagatcctgccgtgtctgtggctctgggccagaccgtgcggatcacctgtcagggcgacagcctgcggagctactacgccagctggtatcagcagaagcccggccaggcccccgtgctggtcatctacggcaagaacaaccggcccagcggcatccccgacagattcagcggcagcagcagcggcaacaccgccagcctgaccatcactggcgcccaggccgaggacgaggccgactactactgcaacagccgggacagctccggcaaccacgtggtgtttggcggaggcaccaagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 304 - DNA, 1344 bp, Artificial Sequence
  Description of Artificial Sequence: Synthetic polynucleotide
caggtgcagctggtgcagtctggcgccgaagtgaagaaacccggcagcagcgtgaaggtgtcctgcaaggccagcggcggcaccttcagcagctacgccatcagctgggtccgacaggccccagggcagggcctggaatggatgggcggcatcatccccatcttcggcaccgccaactacgcccagaaattccagggcagagtgaccatcaccgccgacgagagcaccagcaccgcctacatggaactgagcagcctgcggagcgacgacaccgccgtgtactactgcgccagagccctggaccccatcaccttcgacagctggggccagggcaccctggtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 305 - protein, 610 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSDDTAVYYCARALDPITFDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 306 - DNA, 1830 bp, Artificial Sequence
  Description of Artificial Sequence: Synthetic polynucleotide
caggtgcagctggtgcagtctggcgccgaagtgaagaaacccggcagcagcgtgaaggtgtcctgcaaggccagcggcggcaccttcagcagctacgccatcagctgggtccgacaggccccagggcagggcctggaatggatgggcggcatcatccccatcttcggcaccgccaactacgcccagaaattccagggcagagtgaccatcaccgccgacgagagcaccagcaccgcctacatggaactgagcagcctgcggagcgacgacaccgccgtgtactactgcgccagagccctggaccccatcaccttcgacagctggggccagggcaccctggtcaccgtgtccagcgctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 307 - protein, 214 aa, Artificial Sequence
  Description of Artificial Sequence: Synthetic polypeptide
DIVMTQSQKFMSTSVGDRVSVPCKASQNVDTHVAWYQQKPGQSPKPLIYSAFYRYSGVPDRFTGSGSGTDFTLTISNVKSEDLAEYFCQQYKNYPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 308 - protein, 449 aa, Artificial Sequence
  Description of Artificial Sequence: Synthetic polypeptide
QVQLQQPGSELVRPGASVKLSCKASGYTFTSYWMHWVKQRHGQGLDWIGNIYPGSGNTQYGEKFKSKGTLTVDTSSSTAYMHLSSLTSEDSAVYYCTRRDANFEGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - DNA, 642 bp, Artificial Sequence
  Description of Artificial Sequence: Synthetic polynucleotide
gacattgtgatgacccagtctcaaaaattcatgtccacatcagtcggagacagggtcagcgtcccctgtaaggccagtcagaatgtggatactcatgtagcctggtatcaacagaaaccagggcaatctcctaaaccactgatttactcggcattttaccggtacagtggagtccctgatcgcttcacaggcagtggatctgggacagatttcactctcaccatctccaatgtgaagtctgaagacttggcagagtatttctgtcagcaatataaaaactatcctttcacgttcggctcggggacaaagttggaagtgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 310 - DNA, 1347 bp, Artificial Sequence
  Description of Artificial Sequence: Synthetic polynucleotide
caggtccaactgcagcaacctgggtctgagctggtgaggcctggagcttcagtgaagctgtcctgcaaggcttctggctacacattcaccagttactggatgcactgggtgaaacagaggcatggacaaggccttgactggattggaaatatttatcctggtagtggtaatactcagtacggtgagaagttcaagagcaagggcacactgactgtagacacatcctccagcacagcctacatgcacctcagcagcctgacatctgaagactctgcggtctattactgtacaagaagggatgctaatttcgagggttttgcttattggggccaggggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 311 - protein, 611 aa, Artificial Sequence
  Description of Artificial Sequence: Synthetic polypeptide
QVQLQQPGSELVRPGASVKLSCKASGYTFTSYWMHWVKQRHGQGLDWIGNIYPGSGNTQYGEKFKSKGTLTVDTSSSTAYMHLSSLTSEDSAVYYCTRRDANFEGFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 312 - DNA, 1833 bp, Artificial Sequence
  Description of Artificial Sequence: Synthetic polynucleotide
caggtccaactgcagcaacctgggtctgagctggtgaggcctggagcttcagtgaagctgtcctgcaaggcttctggctacacattcaccagttactggatgcactgggtgaaacagaggcatggacaaggccttgactggattggaaatatttatcctggtagtggtaatactcagtacggtgagaagttcaagagcaagggcacactgactgtagacacatcctccagcacagcctacatgcacctcagcagcctgacatctgaagactctgcggtctattactgtacaagaagggatgctaatttcgagggttttgcttattggggccaggggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 313 - protein, 213 aa, Artificial Sequence
  Description of Artificial Sequence: Synthetic polypeptide
QIVLTQSPAIMSASPGEKVTMTCSVSSSVRFMHWYQQKSGTSPKRWIYDTSKLASGVPARFSGSGSGTSYSLTISSMEAEDAATYYCQQWSSNPPTFGGGTKLKIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - protein, 452 aa, Artificial Sequence
  Description of Artificial Sequence: Synthetic polypeptide
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - DNA, 639 bp, Artificial Sequence
  Description of Artificial Sequence: Synthetic polynucleotide
caaattgttctcacccagtctccagcaatcatgtctgcttctccaggggagaaggtcaccatgacctgcagtgtcagctcaagtgttcgtttcatgcactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggagtagtaacccacccacgttcggaggggggaccaagctgaaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 316 - DNA, 1356 bp, Artificial Sequence
  Description of Artificial Sequence: Synthetic polynucleotide
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 317 - protein, 623 aa, Artificial Sequence
  Description of Artificial Sequence: Synthetic polypeptide
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 318 - DNA, 1869 bp, Artificial Sequence
  Description of Artificial Sequence: Synthetic polynucleotide
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 319 - protein, 620 aa, Artificial Sequence
  Description of Artificial Sequence: Synthetic polypeptide
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 320 - DNA, 1860 bp, Artificial Sequence
  Description of Artificial Sequence: Synthetic polynucleotide
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 321 - protein, 614 aa, Artificial Sequence
  Description of Artificial Sequence: Synthetic polypeptide
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 322 - DNA, 1842 bp, Artificial Sequence
  Description of Artificial Sequence: Synthetic polynucleotide
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 323 - protein, 396 aa, Artificial Sequence
  Description of Artificial Sequence: Synthetic polypeptide
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 324 - DNA, 1188 bp, Artificial Sequence
  Description of Artificial Sequence: Synthetic polynucleotide
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 325 - protein, 396 aa, Artificial Sequence
  Description of Artificial Sequence: Synthetic polypeptide
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 326 - DNA, 1188 bp, Artificial Sequence
  Description of Artificial Sequence: Synthetic polynucleotide
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 327 - protein, 214 aa, Homo sapiens
EIVLTQSPATLSASPGERATLSCRASQSISSNLAWYQQKPGQAPRLLIQDSSTRATGIPARFSGSGSGTEFTLTISSLQSEDFAVYYCQQSDNWPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 455 aa, Homo sapiens
QVQLVQSGAEVKKPGSSVKVSCKASGGNFISYSISWVRQAPGKRLEWMGWIIPIFGTTTYVQKFQGRVTITADESTSTAYMELSSLRSEDTAVYYCARVKYGSGSYYPNNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - DNA, 642 bp, Homo sapiens
gaaattgtgttgacgcagtctccagccaccctgtctgcgtctccaggggaaagagccaccctctcctgcagggccagtcagagtattagcagcaacttagcctggtaccagcagaagcctggccaggctcccaggctcctcatccaggattcatccaccagggccactggtatcccagccaggttcagtggcagtgggtctgggacagagttcactctcaccatcagcagcctgcagtctgaagattttgcagtttattactgtcagcagtctgataactggcccctcactttcggcggagggaccaaagtggatatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 330 - DNA, 1365 bp, Homo sapiens
caggtccagctggtacagtctggggctgaggtgaagaagcctgggtcctcggtgaaagtctcctgcaaggcttctggaggcaacttcatcagttatagtataagttgggtgcgacaggcccctggaaagcggcttgagtggatgggatggatcatccctatatttggaacaacaacttacgtacagaagttccagggcagagtcacgattaccgcggacgaatccacgagcacagcctacatggagctgagcagcctgagatctgaggacacggccgtgtattactgtgcgagagtaaaatacggttcggggagttattaccctaataactggttcgacccctggggccagggaaccctggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 331 - protein, 219 aa, Homo sapiens
DVVMTQSPLSLPVTPGEPASISCRSSQSLLNSNGYNYLEWYVQKPGQSPQLLIFLGSNRASGVPDRFSGSGSGTDFTLKINRVEAEDVGVYYCMQALQSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 453 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDSSSWYFTYGYFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - DNA, 657 bp, Homo sapiens
gatgttgtgatgactcagtctccactctccctgcccgtcacccctggagagccggcctccatctcctgcaggtctagtcagagcctcctcaatagtaatggatacaactatttggagtggtacgtgcagaagccagggcagtctccacagctcctgatctttttgggttctaatcgggcctccggggtccctgacaggttcagtggcagtggatcaggcacagatttcacactgaaaatcaacagagtggaggctgaggatgttggggtttattactgcatgcaagctctacaaagtcctctcactttcggcggagggaccaaggtggaaatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 334 - DNA, 1359 bp, Homo sapiens
caggtccagcttgtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatagcagcagctggtacttcacgtacggatacttccagcactggggccagggcaccctggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 335 - protein, 220 aa, Artificial Sequence
  Description of Artificial Sequence: Synthetic polypeptide
SYGQFTLTQPKSVSGSLRSTITIPCERSSGDIGDNYVSWYQQHLGRPPINVIYADDQRPSEVSDRFSGSIDSSSNSASLTITNLQMDDEADYFCQSYDSNIDIIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 336 - protein, 449 aa, Artificial Sequence
  Description of Artificial Sequence: Synthetic polypeptide
QVQLKESGPGLVQPSETLSLTCTVSGFSLTSYGVNWVRQPPGKGLEWMGRIWNDGSIDYNSALKSRLSISRDTSKGQVFLKMNSLQTEDTAIYFCARGPYNNYWYFDFWGPGTMVTVLSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 220 aa, Artificial Sequence
  Description of Artificial Sequence: Synthetic polypeptide
SYGQFTLTQPKSVSGSLRSTITIPCERSSGDIGDNYVTWYQQHLGRPPLNVIYADDQRPSEVSDRFSGSIDSSSNSASLTITNLQMDDEADYFCQSYDSNTDIIFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 338 - protein, 449 aa, Artificial Sequence
  Description of Artificial Sequence: Synthetic polypeptide
QVQLKESGPGLLLSSETLSLTCTVSGFSLTSYEVSWVRQLPGRGLEWMGRVWIGGDTDYNSDLKSRLSISRDIAKSQVFLKMSNLKTEDTGTYYCARAYGFNYWSFDFWGPGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 214 aa, Artificial Sequence
  Description of Artificial Sequence: Synthetic polypeptide
NIVLTQSPATLSVTPGESVSLSCRASQSIGTSIHWYQQKSNESPRLLIRYASQSISGIPSRFSGSGSGTDFTLSINRVESEDFSIYYCQQSYSSLVTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - protein, 452 aa, Artificial Sequence
  Description of Artificial Sequence: Synthetic polypeptide
QIQLVQSGPGLKKPGESVKISCKASGYTFTDYSMHWVKQAPGKGLQWMGWINTYSGKPTYAADFKGRFVFSLEASASTANLQISNLKNEDTATYFCARCYDGTFYYDPMDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 107 aa, Homo sapiens [sequence omitted]

SEQ ID NO: 342 - protein, 122 aa, Homo sapiens [sequence omitted]

SEQ ID NO: 343 - protein, 106 aa, Homo sapiens
DIELTQPPSVSVAPGQTARISCSGDNIGNKYVSWYQQKPGQAPVVVIYGDNNRPSGIPERFSGSNSGNTATLTISGTQAEDEADYYCSSYDSSYFVFGGGTKLTVL

SEQ ID NO: 344 - protein, 122 aa, Homo sapiens
QVQLVESGGGLVQPGGSLRLSCAASGFTFSSYGMHWVRQAPGKGLEWVSNIYSDGSNTFYADSVKGRFTISRDNSKNTLYLQMNSLRAEDTAVYYCARNMYRWPFHYFFDYWGQGTLVTVSS

SEQ ID NO: 345 - protein, 107 aa, Artificial Sequence [sequence omitted]

SEQ ID NO: 346 - protein, 120 aa, Artificial Sequence [sequence omitted]

SEQ ID NO: 347 - protein, 116 aa, Homo sapiens
QAVLTQPASLSASPGESARLTCTLPSDINVRYYNIYWYQQKPGSPPRYLLYYYSDSHKGQGSGVPSRFSGSKDVSTNSGILLISGLQSEDEADYYCMTWSSNGSGVFGGGTQLTVL

SEQ ID NO: 348 - protein, 121 aa, Homo sapiens
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSS

SEQ ID NO: 349 - protein, 108 aa, Homo sapiens
AIQMTQSPSSLSASVGDRVTITCRASQSISSYLNWYQQKPGKAPKLLIYAASSLQSGVPSRFSGSGSGTDFTLTISSLQPEDFATYYCQQSYFTPLYTFGQGTKLEIK

SEQ ID NO: 350 - protein, 118 aa, Homo sapiens
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSS

SEQ ID NO: 351 - protein, 116 aa, Homo sapiens
QAVLTQPASLSASPGESARLTCTLPSDINVRYYNIYWYQQKPGSPPRYLLYYYSDSHKDQGSGVPSRFSGSKDTSANTGILLISGLQSEDEADYYCMIWASNGSGVLGGGTQLTVL

SEQ ID NO: 352 - protein, 122 aa, Homo sapiens
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSS

SEQ ID NO: 353 - protein, 116 aa, Homo sapiens
QAVLTQPASLSASPGESARLTCTLPSDINVRYHNIYWYQEKPGSPPRYLLYYYSDSSKGQGSGVPSRFSGSKDVSTNTGILVISGLQSEDEAEYYCMTWSSNGSGVFGGGTQLTVL

SEQ ID NO: 354 - protein, 120 aa, Homo sapiens
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSS

SEQ ID NO: 355 - protein, 107 aa, Rattus rattus
DIQMTQSPASLSASLGETVTIECRASEDIYSNLAWYQQKPGNSPQLLIYDANSLADGVPSRFSASGSGTQFSLKINSLRSEDVASYFCQQYNNYPYTFGAGTKLELK

SEQ ID NO: 356 - protein, 120 aa, Rattus rattus
EVQLQQSGPEVGRPGSSVKISCKASGYTFTDYIMHWVKQSPGQGLEWIGWIDPEYGRTDYAEKFKKKATLTADTSSSTAYIQLSSLASEDTATYFCARSAHTTGFGFAYWGQGTLVTVSS

SEQ ID NO: 357 - protein, 112 aa, Rattus rattus
DIVMTQGALPNPVPSGESASITCQSSESLLHSNGKTYLNWYLQRPGQSPQLLIYWMSTRAAGVSDRFSGSGSGTDFTLTISGVEAEDVGVYYCQQFLEYPPTFGSGTKLEIK

SEQ ID NO: 358 - protein, 123 aa, Rattus rattus
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSS

SEQ ID NO: 359 - protein, 107 aa, Rattus rattus
DIVMTQSPTSISISVGERVTMNCKASQNVDSDVDWYQQKTGQSPKLLIYKASNRYTGVPDRFTGSGSGTDFTFTISNMQAEDLAVYYCMQSNTHPRTFGGGTKLELK

SEQ ID NO: 360 - protein, 120 aa, Rattus rattus
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSS

SEQ ID NO: 361 - protein, 106 aa, Mus musculus [sequence omitted]

SEQ ID NO: 362 - protein, 121 aa, Mus musculus [sequence omitted]

SEQ ID NO: 363 - protein, 106 aa, Artificial Sequence
  Description of Artificial Sequence: Synthetic polypeptide
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIK

SEQ ID NO: 364 - protein, 120 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 365 - protein, 107 aa, Mus musculus
DIQMTQSPASLSASVGETVTLTCRASENIHNYLAWYQQKQGKSPQLLVYNVKTLADGVPSRFSGSGSGTQYSLKINSLQPEDFGSYYCQHFWSSPWTFGGGTKVEIK

SEQ ID NO: 366 - protein, 119 aa, Mus musculus
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSA

SEQ ID NO: 367 - protein, 108 aa, Mus musculus
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPWTFGGGTKLEIR

SEQ ID NO: 368 - protein, 120 aa, Mus musculus
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSA

SEQ ID NO: 369 - protein, 107 aa, Mus musculus
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIK

SEQ ID NO: 370 - protein, 122 aa, Mus musculus
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSS

SEQ ID NO: 371 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 372 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSDDTAVYYCARALDPITFDSWGQGTLVTVSS

SEQ ID NO: 373 - protein, 107 aa, Mus musculus
DIVMTQSQKFMSTSVGDRVSVPCKASQNVDTHVAWYQQKPGQSPKPLIYSAFYRYSGVPDRFTGSGSGTDFTLTISNVKSEDLAEYFCQQYKNYPFTFGSGTKLEVK

SEQ ID NO: 374 - protein, 119 aa, Mus musculus
QVQLQQPGSELVRPGASVKLSCKASGYTFTSYWMHWVKQRHGQGLDWIGNIYPGSGNTQYGEKFKSKGTLTVDTSSSTAYMHLSSLTSEDSAVYYCTRRDANFEGFAYWGQGTLVTVSA

SEQ ID NO: 375 - protein, 106 aa, Mus musculus
QIVLTQSPAIMSASPGEKVTMTCSVSSSVRFMHWYQQKSGTSPKRWIYDTSKLASGVPARFSGSGSGTSYSLTISSMEAEDAATYYCQQWSSNPPTFGGGTKLKIK

SEQ ID NO: 376 - protein, 122 aa, Mus musculus
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSS

SEQ ID NO: 377 - protein, 107 aa, Homo sapiens
EIVLTQSPATLSASPGERATLSCRASQSISSNLAWYQQKPGQAPRLLIQDSSTRATGIPARFSGSGSGTEFTLTISSLQSEDFAVYYCQQSDNWPLTFGGGTKVDIK

SEQ ID NO: 378 - protein, 125 aa, Homo sapiens
QVQLVQSGAEVKKPGSSVKVSCKASGGNFISYSISWVRQAPGKRLEWMGWIIPIFGTTTYVQKFQGRVTITADESTSTAYMELSSLRSEDTAVYYCARVKYGSGSYYPNNWFDPWGQGTLVTVSS

SEQ ID NO: 379 - protein, 112 aa, Homo sapiens
DVVMTQSPLSLPVTPGEPASISCRSSQSLLNSNGYNYLEWYVQKPGQSPQLLIFLGSNRASGVPDRFSGSGSGTDFTLKINRVEAEDVGVYYCMQALQSPLTFGGGTKVEIK

SEQ ID NO: 380 - protein, 123 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDSSSWYFTYGYFQHWGQGTLVTVSS

SEQ ID NO: 381 - protein, 114 aa, Rattus rattus
SYGQFTLTQPKSVSGSLRSTITIPCERSSGDIGDNYVSWYQQHLGRPPINVIYADDQRPSEVSDRFSGSIDSSSNSASLTITNLQMDDEADYFCQSYDSNIDIIFGGGTKLTVL

SEQ ID NO: 382 - protein, 119 aa, Rattus rattus
QVQLKESGPGLVQPSETLSLTCTVSGFSLTSYGVNWVRQPPGKGLEWMGRIWNDGSIDYNSALKSRLSISRDTSKGQVFLKMNSLQTEDTAIYFCARGPYNNYWYFDFWGPGTMVTVLS

SEQ ID NO: 383 - protein, 114 aa, Rattus rattus
SYGQFTLTQPKSVSGSLRSTITIPCERSSGDIGDNYVTWYQQHLGRPPLNVIYADDQRPSEVSDRFSGSIDSSSNSASLTITNLQMDDEADYFCQSYDSNTDIIFGGGTKVTVL

SEQ ID NO: 384 - protein, 119 aa, Rattus rattus
QVQLKESGPGLLLSSETLSLTCTVSGFSLTSYEVSWVRQLPGRGLEWMGRVWIGGDTDYNSDLKSRLSISRDIAKSQVFLKMSNLKTEDTGTYYCARAYGFNYWSFDFWGPGTMVTVSS

SEQ ID NO: 385 - protein, 107 aa, Rattus rattus
NIVLTQSPATLSVTPGESVSLSCRASQSIGTSIHWYQQKSNESPRLLIRYASQSISGIPSRFSGSGSGTDFTLSINRVESEDFSIYYCQQSYSSLVTFGSGTKLEIK

SEQ ID NO: 386 - protein, 122 aa, Rattus rattus
QIQLVQSGPGLKKPGESVKISCKASGYTFTDYSMHWVKQAPGKGLQWMGWINTYSGKPTYAADFKGRFVFSLEASASTANLQISNLKNEDTATYFCARCYDGTFYYDPMDAWGQGTSVTVSS

SEQ ID NO: 387 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 388 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 389 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 390 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 391 - protein, 165 aa, Homo sapiens
CDLPQTHSLGSRRTLMLLAQMRRISLFSCLKDRRDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 392 - protein, 166 aa, Homo sapiens
CDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 393 - protein, 622 aa, Homo sapiens
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 394 - DNA, 1866 bp, Artificial Sequence
  Description of Artificial Sequence: Synthetic polynucleotide
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacgcacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 395 - protein, 165 aa, Artificial Sequence
  Description of Artificial Sequence: Synthetic Human interferon alpha-2-b with mutation at amino acid position
  MOD_RES (106)..(106): A, C, D, E, F, G, H, I, K, L, M, N, P, Q, R, V, W, or Y
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVXETPLMKEDSILAVRKYFQRITLYLKEKKYSPCAWEVVRAEIMRSFSLSTNLQESLRSKE

SEQ ID NO: 396 - protein, 164 aa, Artificial Sequence
  Description of Artificial Sequence: Synthetic Human Interferon alpha-2-b with mutation at amino acid at position 106
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVETPLMKEDSILAVRKYFQRITLYLKEKKYSPCAWEVVRAEIMRSFSLSTNLQESLRSKE

SEQ ID NO: 397 - protein, 165 aa, Artificial Sequence
  Description of Artificial Sequence: Synthetic Aglycosylated (T106A) human interferon alpha-2-b comprising attenuating mutation L15A
CDLPQTHSLGSRRTAMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 398 - protein, 165 aa, Artificial Sequence
  Description of Artificial Sequence: Synthetic Aglycosylated (T106A) human interferon alpha-2-b comprising attenuating mutation A19W
CDLPQTHSLGSRRTLMLLWQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 399 - protein, 165 aa, Artificial Sequence
  Description of Artificial Sequence: Synthetic Aglycosylated (T106A) human interferon alpha-2-b comprising attenuating mutation R22A
CDLPQTHSLGSRRTLMLLAQMARISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 400 - protein, 165 aa, Artificial Sequence
  Description of Artificial Sequence: Synthetic Aglycosylated (T106A) human interferon alpha-2-b comprising attenuating mutation R23A
CDLPQTHSLGSRRTLMLLAQMRAISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 401 - protein, 165 aa, Artificial Sequence
  Description of Artificial Sequence: Synthetic Aglycosylated (T106A) human interferon alpha-2-b comprising attenuating mutation R25A
CDLPQTHSLGSRRTLMLLAQMRRIALFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 402 - protein, 165 aa, Artificial Sequence
  Description of Artificial Sequence: Synthetic Aglycosylated (T106A) human interferon alpha-2-b comprising attenuating mutation L26A
CDLPQTHSLGSRRTLMLLAQMRRISAFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 403 - protein, 165 aa, Artificial Sequence
  Description of Artificial Sequence: Synthetic Aglycosylated (T106A) human interferon alpha-2-b comprising attenuating mutation F27A
CDLPQTHSLGSRRTLMLLAQMRRISLASCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 404 - protein, 165 aa, Artificial Sequence
  Description of Artificial Sequence: Synthetic Aglycosylated (T106A) human interferon alpha-2-b comprising attenuating mutation L30X, where X can be any amino acid selected from A, V
  MOD_RES (30)..(30): A or V
CDLPQTHSLGSRRTLMLLAQMRRISLFSCXKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 405 - protein, 165 aa, Artificial Sequence
  Description of Artificial Sequence: Synthetic Aglycosylated (T106A) human interferon alpha-2-b comprising attenuating mutation K31A
CDLPQTHSLGSRRTLMLLAQMRRISLFSCLADRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 406 - protein, 165 aa, Artificial Sequence
  Description of Artificial Sequence: Synthetic Aglycosylated (T106A) human interferon alpha-2-b comprising attenuating mutation D32A
CDLPQTHSLGSRRTLMLLAQMRRISLFSCLKARHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 407 - protein, 165 aa, Artificial Sequence
  Description of Artificial Sequence: Synthetic Aglycosylated (T106A) human interferon alpha-2-b comprising attenuating mutation R33X, where X can be any amino acid selected from K, A, Q
  MOD_RES (33)..(33): K, A or Q
CDLPQTHSLGSRRTLMLLAQMRRISLFSCLKDXHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 408 - protein, 165 aa, Artificial Sequence
  Description of Artificial Sequence: Synthetic Aglycosylated (T106A) human interferon alpha-2-b comprising attenuating mutation H34A
CDLPQTHSLGSRRTLMLLAQMRRISLFSCLKDRADFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 409 - protein, 165 aa, Artificial Sequence
  Description of Artificial Sequence: Synthetic Aglycosylated (T106A) human interferon alpha-2-b comprising attenuating mutation Q40A
CDLPQTHSLGSRRTLMLLAQMRRISLFSCLKDRHDFGFPAEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 410 - protein, 165 aa, Artificial Sequence
  Description of Artificial Sequence: Synthetic Aglycosylated (T106A) human interferon alpha-2-b comprising attenuating mutation D114R
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKERSILAVRKYFQRITLYLKEKKYSPCAWEVVRAEIMRSFSLSTNLQESLRSKE

SEQ ID NO: 411 - protein, 165 aa, Artificial Sequence
  Description of Artificial Sequence: Synthetic Aglycosylated (T106A) human interferon alpha-2-b comprising attenuating mutation L117A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSIAAVRKYFQRITLYLKEKKYSPCAWEVVRAEIMRSFSLSTNLQESLRSKE

SEQ ID NO: 412 - protein, 165 aa, Artificial Sequence
  Description of Artificial Sequence: Synthetic Aglycosylated (T106A) human interferon alpha-2-b comprising attenuating mutation R120X where X can be any amino acid selected from A, E
  MOD_RES (120)..(120): A or E
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVXKYFQRITLYLKEKKYSPCAWEVVRAEIMRSFSLSTNLQESLRSKE

SEQ ID NO: 413 - protein, 165 aa, Artificial Sequence
  Description of Artificial Sequence: Synthetic Aglycosylated (T106A) human interferon alpha-2-b comprising attenuating mutation R125X where X can be any amino acid selected from A, E
  MOD_RES (125)..(125): A or E
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQXITLYLKEKKYSPCAWEVVRAEIMRSFSLSTNLQESLRSKE

SEQ ID NO: 414 - protein, 165 aa, Artificial Sequence
  Description of Artificial Sequence: Synthetic Aglycosylated (T106A) human interferon alpha-2-b comprising attenuating mutation K131A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLAEKKYSPCAWEVVRAEIMRSFSLSTNLQESLRSKE

SEQ ID NO: 415 - protein, 165 aa, Artificial Sequence
  Description of Artificial Sequence: Synthetic Aglycosylated (T106A) human interferon alpha-2-b comprising attenuating mutation E132A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKAKKYSPCAWEVVRAEIMRSFSLSTNLQESLRSKE

SEQ ID NO: 416 - protein, 165 aa, Artificial Sequence
  Description of Artificial Sequence: Synthetic Aglycosylated (T106A) human interferon alpha-2-b comprising attenuating mutation K133A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEAKYSPCAWEVVRAEIMRSFSLSTNLQESLRSKE

SEQ ID NO: 417 - protein, 165 aa, Artificial Sequence
  Description of Artificial Sequence: Synthetic Aglycosylated (T106A) human interferon alpha-2-b comprising attenuating mutation K134A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKAYSPCAWEVVRAEIMRSFSLSTNLQESLRSKE

SEQ ID NO: 418 - protein, 165 aa, Artificial Sequence
  Description of Artificial Sequence: Synthetic Aglycosylated (T106A) human interferon alpha-2-b comprising attenuating mutation R144X where X can be any amino acid selected from A, D, E, G, H, I, K, L, N, Q, S, T, V, Y
  MOD_RES (144)..(144): A, D, E, G, H, I, K, L, N, Q, S, T, V, or Y
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVXAEIMRSFSLSTNLQESLRSKE

SEQ ID NO: 419 - protein, 165 aa, Artificial Sequence
  Description of Artificial Sequence: Synthetic Aglycosylated (T106A) human interferon alpha-2-b comprising attenuating mutation A145X where X can be any amino acid selected from D, E, G, H, I, K, L, M, N, Q, R, S, T, V, Y
  MOD_RES (145)..(145): D, E, G, H, I, K, L, M, N, Q, R, S, T, V, or Y
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRXEIMRSFSLSTNLQESLRSKE

SEQ ID NO: 420 - protein, 165 aa, Artificial Sequence
  Description of Artificial Sequence: Synthetic Aglycosylated (T106A) human interferon alpha-2-b comprising attenuating mutation M148A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIARSFSLSTNLQESLRSKE

SEQ ID NO: 421 - protein, 165 aa, Artificial Sequence
  Description of Artificial Sequence: Synthetic Aglycosylated (T106A) human interferon alpha-2-b comprising attenuating mutation R149A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMASFSLSTNLQESLRSKE

SEQ ID NO: 422 - protein, 165 aa, Artificial Sequence
  Description of Artificial Sequence: Synthetic Aglycosylated (T106A) human interferon alpha-2-b comprising attenuating mutation S152A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFALSTNLQESLRSKE

SEQ ID NO: 423 - protein, 165 aa, Artificial Sequence
  Description of Artificial Sequence: Synthetic Aglycosylated (T106A) human interferon alpha-2-b comprising attenuating mutation L153A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSASTNLQESLRSKE

SEQ ID NO: 424 - protein, 165 aa, Artificial Sequence
  Description of Artificial Sequence: Synthetic Aglycosylated (T106A) human interferon alpha-2-b comprising attenuating mutation N156A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTALQESLRSKE

SEQ ID NO: 425 - protein, 612 aa, Artificial Sequence
  Description of Artificial Sequence: Synthetic A10.21 IgG4 (S228P) IFN (A592D, T553X) where X can be any amino acid selected from A, G, E, S, V
  MOD_RES (553)..(553): A, G, E, S, or V
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVXETPLMKEDSILAVRKYFQRITLYLKEKKYSPCAWEVVRDEIMRSFSLSTNLQESLRSKE

SEQ ID NO: 426 - protein, 165 aa, Artificial Sequence
  Description of Artificial Sequence: Synthetic Aglycosylated (T106A) human interferon alpha-2-b comprising attenuating mutations L30A, H57Y, E58N and Q61S
CDLPQTHSLGSRRTLMLLAQMRRISLFSCAKDRHDFGFPQEEFGNQFQKAETIPVLYNMISQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 427 - protein, 165 aa, Artificial Sequence
  Description of Artificial Sequence: Synthetic Aglycosylated (T106A) human interferon alpha-2-b comprising attenuating mutations R33A, H57Y, E58N and Q61S
CDLPQTHSLGSRRTLMLLAQMRRISLFSCLKDAHDFGFPQEEFGNQFQKAETIPVLYNMISQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 428 - protein, 165 aa, Artificial Sequence
  Description of Artificial Sequence: Synthetic Aglycosylated (T106A) human interferon alpha-2-b comprising attenuating mutations M148A, H57Y, E58N and Q61S
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVAETPLMKEDSILAVRKYFQRITLYLKEKKYSPCAWEVVRAEIARSFSLSTNLQESLRSKE

SEQ ID NO: 429 - protein, 165 aa, Artificial Sequence
  Description of Artificial Sequence: Synthetic Aglycosylated (T106A) human interferon alpha-2-b comprising attenuating mutations L153A, H57Y, E58N and Q61S
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVAETPLMKEDSILAVRKYFQRITLYLKEKKYSPCAWEVVRAEIMRSFSASTNLQESLRSKE

SEQ ID NO: 430 - protein, 165 aa, Artificial Sequence
  Description of Artificial Sequence: Synthetic Aglycosylated (T106A) human interferon alpha-2-b comprising attenuating mutations R144A, H57Y, E58N and Q61S
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVAETPLMKEDSILAVRKYFQRITLYLKEKKYSPCAWEVVAAEIMRSFSLSTNLQESLRSKE

SEQ ID NO: 431 - protein, 165 aa, Artificial Sequence
  Description of Artificial Sequence: Synthetic Aglycosylated (T106A) human interferon alpha-2-b comprising attenuating mutations N65A,L80A, Y85A, Y89A
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVAETPLMKEDSILAVRKYFQRITLYLKEKKYSPCAWEVVRAEIMRSFSLSTNLQESLRSKE

SEQ ID NO: 432 - protein, 165 aa, Artificial Sequence
  Description of Artificial Sequence: Synthetic Aglycosylated (T106A) human interferon alpha-2-b comprising attenuating mutations N65A,L80A, Y85A, Y89A and D114A
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVAETPLMKEASILAVRKYFQRITLYLKEKKYSPCAWEVVRAEIMRSFSLSTNLQESLRSKE

SEQ ID NO: 433 - protein, 165 aa, Artificial Sequence
  Description of Artificial Sequence: Synthetic Aglycosylated (T106A) human interferon alpha-2-b comprising attenuating mutations N65A,L80A, Y85A, Y89A and L117A
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVAETPLMKEDSIAAVRKYFQRITLYLKEKKYSPCAWEVVRAEIMRSFSLSTNLQESLRSKE

SEQ ID NO: 434 - protein, 165 aa, Artificial Sequence
  Description of Artificial Sequence: Synthetic Aglycosylated (T106A) human interferon alpha-2-b comprising attenuating mutations N65A,L80A, Y85A, Y89A and R120A
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVAETPLMKEDSILAVAKYFQRITLYLKEKKYSPCAWEVVRAEIMRSFSLSTNLQESLRSKE

SEQ ID NO: 435 - protein, 165 aa, Artificial Sequence
  Description of Artificial Sequence: Synthetic Aglycosylated (T106A) human interferon alpha-2-b comprising attenuating mutations Y85A, Y89A and R120A
CDLPQTHSLGSRRTLMLLAQMRRISLFSCLKDRHDFGFPQEEFGNQFQKAETIPVLHEMIQQIFNLFSTKDSSAAWDETLLDKFATELAQQLNDLEACVIQGVGVAETPLMKEDSILAVAKYFQRITLYLKEKKYSPCAWEVVRAEIMRSFSLSTNLQESLRSKE

SEQ ID NO: 436 - protein, 165 aa, Artificial Sequence
  Description of Artificial Sequence: Synthetic Aglycosylated (T106A) human interferon alpha-2-b comprising attenuating mutations D114A,R120A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEASILAVAKYFQRITLYLKEKKYSPCAWEVVRAEIMRSFSLSTNLQESLRSKE

SEQ ID NO: 437 - protein, 165 aa, Artificial Sequence
  Description of Artificial Sequence: Synthetic Aglycosylated (T106A) human interferon alpha-2-b comprising attenuating mutations L117A,R120A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSIAAVAKYFQRITLYLKEKKYSPCAWEVVRAEIMRSFSLSTNLQESLRSKE

SEQ ID NO: 438 - protein, 165 aa, Artificial Sequence
  Description of Artificial Sequence: Synthetic Aglycosylated (T106A) human interferon alpha-2-b comprising attenuating mutations L117A,R120A,K121A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSIAAVAAYFQRITLYLKEKKYSPCAWEVVRAEIMRSFSLSTNLQESLRSKE

SEQ ID NO: 439 - protein, 165 aa, Artificial Sequence
  Description of Artificial Sequence: Synthetic Aglycosylated (T106A) human interferon alpha-2-b comprising attenuating mutations R120A,K121A
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVAAYFQRITLYLKEKKYSPCAWEVVRAEIMRSFSLSTNLQESLRSKE

SEQ ID NO: 440 - protein, 165 aa, Artificial Sequence
  Description of Artificial Sequence: Synthetic Aglycosylated (T106A) human interferon alpha-2-b comprising attenuating mutations R120E,K121E
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVEEYFQRITLYLKEKKYSPCAWEVVRAEIMRSFSLSTNLQESLRSKE

SEQ ID NO: 441 - protein, 160 aa, Artificial Sequence
  Description of Artificial Sequence: Synthetic Aglycosylated (T106A) human interferon alpha-2-b comprising attenuating deletion of residues L161-E165
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQES

SEQ ID NO: 442 - protein, 447 aa, Artificial Sequence
  Description of Artificial Sequence: Synthetic VH sequence of 10.21 formatted as IgG4 incorporating hinge stabilisation substitution S228P
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 443 - protein, 447 aa, Artificial Sequence
  Description of Artificial Sequence: Synthetic VH sequence of 10.21 formatted as an IgG4 incorporating hinge stabilisation substitution S228P and YTE residues substituted in positions 252, 254, 256 respectively
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 444 - protein, 450 aa, Artificial Sequence
  Description of Artificial Sequence: Synthetic VH sequence of 10.21 formatted as an IgG1
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 445 - protein, 450 aa, Artificial Sequence
  Description of Artificial Sequence: Synthetic VH sequence of 10.21 formatted as an IgG1 incorporating substitutions L238A and G240A to reduce effector function
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 446 - protein, 450 aa, Artificial Sequence
  Description of Artificial Sequence: Synthetic VH sequence of 10.21 formatted as an IgG1 incorporating substitutions L235A and G237A (reduce effector function) and M255Y, S257T, T259E
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 447 - protein, 446 aa, Artificial Sequence
  Description of Artificial Sequence: Synthetic VH sequence of 10.21 formatted onto an IgG2 backbone
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 448 - protein, 446 aa, Artificial Sequence
  Description of Artificial Sequence: Synthetic VH sequence of 10.21 formatted onto an IgG2 backbone incorporating substitutions M251Y, S253T and T255E
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLYITREPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 449 - protein, 447 aa, Artificial Sequence
  Description of Artificial Sequence: Synthetic VH sequence of 10.43 formatted onto an IgG4 backbone incorporating the hinge stabilisation substitution S228P
QVQLVQSGAEVKKPGASVKVSCKVSGYTLTDSVMNWVRQAPGKGLEWMGWIDPEYGRTDVAQKFQGRVTMTADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 450 - protein, 447 aa, Artificial Sequence
  Description of Artificial Sequence: Synthetic VH sequence of 10.152 formatted as an IgG4 incorporating the hinge stabilisation substitution S228P
EVQLVQSGAEVKKPGATVKISCKVSGYTFTDSVMNWVQQHPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 451 - protein, 448 aa, Artificial Sequence
  Description of Artificial Sequence: Synthetic X2.12 VH sequence formatted as an IgG4 (S228P)
QLQLQESGPGLVKPSETLSLTCTVSGGSISSSSYYWSWIRQHPGKGLEWIGYIYYSGSTNYNPSLKSRVTISVDTSKNQFSLKLSSVTAADTAVYYCARVGGAGGWPLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 452 - protein, 449 aa, Artificial Sequence
  Description of Artificial Sequence: Synthetic Anti-CD138 VH sequence formatted onto an IgG4 (S228P) backbone
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 453 - protein, 447 aa, Artificial Sequence
  Description of Artificial Sequence: Synthetic Anti-HLA VH sequence formatted onto IgG4 incorporating the hinge stabilising substitution S228P
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 454 - protein, 611 aa, Artificial Sequence
  Description of Artificial Sequence: Synthetic A10.21VH sequence formatted onto IgG4 backbone incorporating hinge stabilisation subsitution S228P and the deletion of Threonine residue at position 553 (ie:T106 in interferon sequence)
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVETPLMKEDSILAVRKYFQRITLYLKEKKYSPCAWEVVRDEIMRSFSLSTNLQESLRSKE

SEQ ID NO: 455 - protein, 612 aa, Artificial Sequence
  Description of Artificial Sequence: Synthetic A10.21 IgG4 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 456 - protein, 612 aa, Artificial Sequence
  Description of Artificial Sequence: Synthetic A10.21 IgG4 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVIAEIMRSFSLSTNLQESLRSKE

SEQ ID NO: 457 - protein, 612 aa, Artificial Sequence
  Description of Artificial Sequence: Synthetic A10.21 IgG4 IFN
  MOD_RES (592)..(592): G or K
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRXEIMRSFSLSTNLQESLRSKE

SEQ ID NO: 458 - protein, 612 aa, Artificial Sequence
  Description of Artificial Sequence: Synthetic A10.21 IgG4 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRAEIMRSFSLSTNLQESLRSKE

SEQ ID NO: 459 - protein, 612 aa, Artificial Sequence; identical to SEQ ID NO: 457
  Description of Artificial Sequence: Synthetic A10.21 IgG4 IFN
  MOD_RES (592)..(592): Q or N

SEQ ID NO: 460 - protein, 612 aa, Artificial Sequence
  Description of Artificial Sequence: Synthetic A10.21 IgG4 IFN
  MOD_RES (591)..(591): H or N
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVXAEIMRSFSLSTNLQESLRSKE

SEQ ID NO: 461 - protein, 615 aa, Artificial Sequence
  Description of Artificial Sequence: Synthetic A10.21 IgG1 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 462 - protein, 615 aa, Artificial Sequence
  Description of Artificial Sequence: Synthetic A10.21 IgG1 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 463 - protein, 615 aa, Artificial Sequence
  Description of Artificial Sequence: Synthetic A10.21 IgG1 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 464 - protein, 615 aa, Artificial Sequence
  Description of Artificial Sequence: Synthetic A10.21 IgG1 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 465 - protein, 611 aa, Artificial Sequence
  Description of Artificial Sequence: Synthetic A10.21 IgG2 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 466 - protein, 611 aa, Artificial Sequence
  Description of Artificial Sequence: Synthetic A10.21 IgG2 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLYITREPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 467 - protein, 612 aa, Artificial Sequence
  Description of Artificial Sequence: Synthetic A10.43 IgG4 IFN
QVQLVQSGAEVKKPGASVKVSCKVSGYTLTDSVMNWVRQAPGKGLEWMGWIDPEYGRTDVAQKFQGRVTMTADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 468 - protein, 612 aa, Artificial Sequence
  Description of Artificial Sequence: Synthetic R10A2 IgG4 IFN
  MOD_RES (553)..(553): A, C, D, E, F, G, H, I, L, K, M, N, P, Q, R, S, V, W, or Y
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVXETPLMKEDSILAVRKYFQRITLYLKEKKYSPCAWEVVRDEIMRSFSLSTNLQESLRSKE

SEQ ID NO: 469 - protein, 612 aa, Artificial Sequence
  Description of Artificial Sequence: Synthetic A10.152 IgG4 IFN
EVQLVQSGAEVKKPGATVKISCKVSGYTFTDSVMNWVQQHPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 470 - protein, 613 aa, Artificial Sequence
  Description of Artificial Sequence: Synthetic A02.12 IgG4 IFN
QLQLQESGPGLVKPSETLSLTCTVSGGSISSSSYYWSWIRQHPGKGLEWIGYIYYSGSTNYNPSLKSRVTISVDTSKNQFSLKLSSVTAADTAVYYCARVGGAGGWPLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 471 - protein, 614 aa, Artificial Sequence
  Description of Artificial Sequence: Synthetic Anti-CD138 IgG4 IFN
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 472 - protein, 612 aa, Artificial Sequence
  Description of Artificial Sequence: Synthetic Anti-HLA IgG4 IFN
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 473 - protein, 214 aa, Artificial Sequence
  Description of Artificial Sequence: Synthetic A10.21 and A10.43 light chain
DIQMTQSPSSLSASVGDRVTITCKASQNVDSDVDWYQQKPGKAPKLLIYKASNDYTGVPSRFSGSGSGTDFTFTISSLQPEDIATYYCMQSNTHPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 474 - protein, 214 aa, Artificial Sequence; identical to SEQ ID NO: 247
  Description of Artificial Sequence: Synthetic R10A2 light chain

SEQ ID NO: 475 - protein, 614 aa, Artificial Sequence
  Description of Artificial Sequence: Synthetic A10.21 IgG1 IFN
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVETPLMKEDSILAVRKYFQRITLYLKEKKYSPCAWEVVRDEIMRSFSLSTNLQESLRSKE

SEQ ID NO: 476 - protein, 222 aa, Artificial Sequence
  Description of Artificial Sequence: Synthetic A02.12 lambda light chain
QAVLTQPASLSASPGESARLTCTLPSDINVRYYNIYWYQQKPGSPPRYLLYYYSDSHKGQGSGVPSRFSGSKDVSTNSGILLISGLQSEDIATYYCMTWSSNGSGVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 477 - protein, 214 aa, Artificial Sequence; identical to SEQ ID NO: 295
  Description of Artificial Sequence: Synthetic Anti-CD138 light chain

SEQ ID NO: 478 - protein, 215 aa, Artificial Sequence; identical to SEQ ID NO: 281
  Description of Artificial Sequence: Synthetic Anti-HLA light chain

SEQ ID NO: 479 - protein, 612 aa, Artificial Sequence
  Description of Artificial Sequence: Synthetic A10.21 IgG4 (S228P) IFN (A145D, T106A)
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 480 - DNA, 495 bp, Artificial Sequence
  Description of Artificial Sequence: Synthetic IFN alpha-2-beta
tgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 481 - DNA, 1341 bp, Artificial Sequence
  Description of Artificial Sequence: Synthetic Polynucleotide of 10.21 as an IgG2 incorporating S228P
gaagtgcagctggtgcagtctggcgccgaagtgaagaaacccggcgctaccgtgaagatctcctgcaaggtgtccggctacaccttcaccgactccgtgatgaactgggtgcagcaggcccctggcaagggcctggaatggatgggctggatcgaccccgagtacggcagaaccgacgtggccgagaagttccagggcagagtgaccatcaccgccgacacctccaccgacaccgcctacatggaactgtcctccctgcggagcgaggacaccgccgtgtactactgcgcccggaccaagtacaactccggctacggcttcccctactggggccagggcaccaccgtgaccgtgtcctccgcctccaccaagggcccctccgtgttccctctggccccttgctcccggtccacctccgagtctaccgccgctctgggctgcctggtcaaggactacttccccgagcctgtgacagtgtcctggaactctggcgccctgacctccggcgtgcacaccttccctgccgtgctgcagtcctccggcctgtactccctgtcctccgtcgtgaccgtgccttccagctccctgggcaccaagacctacacctgtaacgtggaccacaagccctccaacaccaaggtggacaagcgggtggaatctaagtacggccctccctgccccccctgccctgcccctgaatttctgggcggaccttccgtgttcctgttccccccaaagcccaaggacaccctgatgatctcccggacccccgaagtgacctgcgtggtggtggacgtgtcccaagaggaccccgaggtgcagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggacagccccgcgagccccaggtgtacaccctgccccctagccaagaggaaatgaccaagaaccaggtgtccctgacctgcctcgtgaagggcttctacccctccgatatcgccgtggaatgggagtccaacggccagcccgagaacaactacaagaccaccccccctgtgctggactccgacggctccttcttcctgtactctcggctgaccgtggacaagtcccggtggcaagagggcaacgtgttctcctgctccgtgatgcacgaggccctgcacaaccactacacccagaagtccctgtccctgagcctgggcaag

SEQ ID NO: 482 - DNA, 1341 bp, Artificial Sequence
  Description of Artificial Sequence: Synthetic Polynucleotide of 10.43 as an IgG2 incorporating S228P
caggtgcagctggtgcagtctggcgccgaagtgaagaaacctggcgcctccgtgaaggtgtcctgcaaggtgtccggctacaccctgaccgactccgtgatgaactgggtccgacaggcccctggcaagggcctggaatggatgggctggatcgaccccgagtacggcagaaccgacgtggcccagaaattccagggcagagtgaccatgaccgccgacacctccaccgacaccgcctacatggaactgtcctccctgcggagcgaggacaccgccgtgtactactgcgcccggaccaagtacaactccggctacggcttcccctactggggccagggcaccaccgtgaccgtgtcctctgcttccaccaagggcccctccgtgttccctctggccccttgctcccggtccacctccgagtctaccgccgctctgggctgcctggtcaaggactacttccccgagcctgtgacagtgtcctggaactctggcgccctgacctccggcgtgcacaccttccctgccgtgctgcagtcctccggcctgtactccctgtcctccgtcgtgaccgtgccttccagctccctgggcaccaagacctacacctgtaacgtggaccacaagccctccaacaccaaggtggacaagcgggtggaatctaagtacggccctccctgccccccctgccctgcccctgaatttctgggcggaccttccgtgttcctgttccccccaaagcccaaggacaccctgatgatctcccggacccccgaagtgacctgcgtggtggtggacgtgtcccaagaggaccccgaggtgcagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggacagccccgcgagccccaggtgtacaccctgccccctagccaagaggaaatgaccaagaaccaggtgtccctgacctgcctcgtgaagggcttctacccctccgatatcgccgtggaatgggagtccaacggccagcccgagaacaactacaagaccaccccccctgtgctggactccgacggctccttcttcctgtactctcggctgaccgtggacaagtcccggtggcaagagggcaacgtgttctcctgctccgtgatgcacgaggccctgcacaaccactacacccagaagtccctgtccctgagcctgggcaag

SEQ ID NO: 483 - DNA, 1344 bp, Artificial Sequence
  Description of Artificial Sequence: Synthetic Polynucleotide of 2.12 formatted an an IgG4 incorporating S228P
cagctgcagctgcaggaatctggccctggcctcgtgaagcccagcgagacactgagcctgacctgtaccgtgtccggcggcagcatcagcagcagctcctactactggtcctggatcagacagcaccccggcaagggcctggaatggatcggctacatctactacagcggcagcaccaactacaaccccagcctgaagtccagagtgaccatcagcgtggacaccagcaagaaccagttctccctgaagctgagcagcgtgacagccgccgataccgccgtgtactactgtgccagagtgggcggagctggcggctggcctctggatgtgtggggacagggcaccaccgtgacagtgtcctcagctagcaccaagggccccagcgtgttccctctggccccttgtagcagaagcaccagcgagtctacagccgccctgggctgcctcgtgaaggactactttcccgagcccgtcaccgtgtcctggaactctggcgctctgacaagcggcgtgcacacctttccagccgtgctgcagagcagcggcctgtactctctgagcagcgtcgtgaccgtgcccagctctagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgacagtgctgcaccaggactggctgaacggcaaagagtacaagtgcaaggtgtccaacaagggcctgcctagcagcatcgagaaaaccatcagcaaggccaagggccagccccgcgaacctcaggtgtacacactgccccctagccaggaagagatgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcagactgaccgtggacaagagccggtggcaggaaggcaacgtgttcagctgcagcgtgatgcacgaggccctgcacaaccactacacccagaagtccctgtccctgtctctgggcaag

SEQ ID NO: 484 - DNA, 1341 bp, Artificial Sequence
  Description of Artificial Sequence: Synthetic Polynucleotide of R10A2 formatted an an IgG4 incorporating S228P
gaagtccagctgcagcagtctggccccgaagtgggcagacctggctcctccgtgaagatctcctgcaaggcctccggctacaccttcaccgactccgtgatgaactgggtcaagcagtctcccggccagggcctggaatggatcggatggatcgaccccgagtacggcagaaccgacgtggccgagaagttcaagaagaaggccaccctgaccgccgactcctccagctccaccgcctacatctacctgtccggcctgacctccgaggacaccgccacctacttttgcgcccggaccaagtacaacagcggctacggcttcccctactggggacagggctctctcgtgacagtgtcctcagcctccaccaagggcccctccgtgttccctctggccccttgctcccggtccacctccgagtctaccgccgctctgggctgcctggtgaaagactacttccccgagcctgtgaccgtgagctggaactctggcgccctgacctccggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgcccctgaatttctgggcggaccttccgtgtttctgttccccccaaagcccaaggacaccctgatgatctcccggacccccgaagtgacctgcgtggtggtggacgtgtcccaggaagatccagaggtgcagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaggtgtccaacaagggcctgccctccagcatcgaaaagaccatctccaaggccaagggccagccccgcgagccccaggtgtacaccctgccccctagccaggaagagatgaccaagaaccaggtgtccctgacctgtctggtgaaaggcttctacccctccgacattgccgtggaatgggagtccaacggccagcccgagaacaactacaagaccaccccccctgtgctggactccgacggctccttcttcctgtactctcggctgacagtggataagtcccggtggcaggaaggcaacgtgttctcctgcagcgtgatgcacgaggccctgcacaaccactatacccagaagtccctgtccctgagcctgggcaag

SEQ ID NO: 485 - DNA, 642 bp, Artificial Sequence
  Description of Artificial Sequence: Synthetic Polynucleotide sequence of R10A2 VK
gacatcgtgatgacccagagccccacctccatctccatcagcgtgggcgagcgcgtgaccatgaactgcaaggcctcccagaacgtggacagcgacgtggactggtatcagcagaaaaccggccagtcccccaagctgctgatctacaaggccagcaacagatacaccggcgtgcccgacaggttcaccggctctggctctggaaccgacttcaccttcaccatcagcaacatgcaggccgaggatctggccgtgtactactgtatgcagtccaacacccacccccggaccttcggcggaggcaccaaactggaactgaagcggaccgtggccgctcccagcgtgttcatcttcccccccagcgacgagcagctgaagagcggcaccgccagcgtggtctgcctgctgaacaacttctacccccgggaggccaaggtgcagtggaaggtggacaacgccctgcagtctggcaacagccaggaaagcgtcaccgagcaggacagcaaggatagcacctacagcctgagcagcaccctgaccctgagcaaggccgactacgagaagcacaaggtgtacgcctgcgaggtcacccaccagggcctgtctagccccgtcaccaagagcttcaaccggggcgagtgc

SEQ ID NO: 486 - DNA, 642 bp, Artificial Sequence
  Description of Artificial Sequence: Synthetic Polynucleotide sequence of VK used to generate antibody 10.21 and antibody 10.43
gacatccagatgacccagtccccctccagcctgtccgcttccgtgggcgacagagtgaccatcacatgcaaggcctcccagaacgtggactccgacgtggactggtatcagcagaagcccggcaaggcccccaagctgctgatctacaaggcctccaacgactacaccggcgtgccctccagattctccggctccggctctggcaccgacttcaccttcaccatctccagcctgcagcccgaggatatcgccacctactactgcatgcagagcaacacccacccccggaccttcggcggaggcaccaaggtggaaatcaagcggaccgtggccgctccctccgtgttcatcttcccaccctccgacgagcagctgaagtccggcaccgcctccgtcgtgtgcctgctgaacaacttctacccccgcgaggccaaggtgcagtggaaggtggacaacgccctgcagtccggcaactcccaagagtccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 487 - DNA, 1341 bp, Artificial Sequence
  Description of Artificial Sequence: Synthetic Polynucleotide sequence of 10.152 formatted as an IgG4 incorporating S228P
gaagtgcagctggtgcagtctggcgccgaagtgaagaaacccggcgctaccgtgaagatctcctgcaaggtgtccggctacaccttcaccgactccgtgatgaactgggtgcagcagcatcccggcaagggcctggaatggatgggctggatcgaccccgagtacggcagaaccgacgtggccgagaagttccagggcagagtgaccatcaccgccgacacctccaccgacaccgcctacatggaactgtcctccctgcggagcgaggacaccgccgtgtactactgcgcccggaccaagtacaactccggctacggcttcccctactggggccagggcaccaccgtgaccgtgtcctctgcctccaccaagggcccctccgtgttccctctggccccttgctcccggtccacctccgagtctaccgccgctctgggctgcctggtcaaggactacttccccgagcctgtgacagtgtcctggaactctggcgccctgacctccggcgtgcacaccttccctgccgtgctgcagtcctccggcctgtactccctgtcctccgtcgtgaccgtgccttccagctccctgggcaccaagacctacacctgtaacgtggaccacaagccctccaacaccaaggtggacaagcgggtggaatctaagtacggccctccctgccccccctgccctgcccctgaatttctgggcggaccttccgtgttcctgttccccccaaagcccaaggacaccctgatgatctcccggacccccgaagtgacctgcgtggtggtggacgtgtcccaagaggaccccgaggtgcagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggacagccccgcgagccccaggtgtacaccctgccccctagccaagaggaaatgaccaagaaccaggtgtccctgacctgcctcgtgaagggcttctacccctccgatatcgccgtggaatgggagtccaacggccagcccgagaacaactacaagaccaccccccctgtgctggactccgacggctccttcttcctgtactctcggctgaccgtggacaagtcccggtggcaagagggcaacgtgttctcctgctccgtgatgcacgaggccctgcacaaccactacacccagaagtccctgtccctgagcctgggcaag

SEQ ID NO: 488 - protein, 214 aa, Artificial Sequence
  Description of Artificial Sequence: Synthetic Amino acid sequence of 10.152 light chain
DIQMTQSPSSLSASVGDRVTITCQASQNVDSDVDWYQQKPGKAPKLLIYKASNDYTGVPSRFSGSGSGTDFTFTISSLQPEDIATYYCAQSNTHPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 489 - DNA, 642 bp, Artificial Sequence
  Description of Artificial Sequence: Synthetic Polynucleotide sequence of 10.152 light chain
gacatccagatgactcagagcccgtcctcgctttcggcttccgtcggcgaccgcgtgaccatcacttgtcaggcgtcgcagaacgtcgattccgacgtggactggtaccaacagaagccggggaaagcgcccaagctgctgatctacaaggcctccaatgattacactggagtgcctagccggttcagcggatcagggtcgggaacggacttcacttttaccatctcaagcctccaaccagaagatattgccacctattactgcgcacaatcaaacacccacccgagaaccttcggcggaggaaccaaggtggagatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 490 - DNA, 666 bp, Artificial Sequence
  Description of Artificial Sequence: Synthetic Polynucleotide sequence of 2.12 light chain
caggccgtgctgacccagcctgcctccctgtctgcctctcctggcgagtccgccagactgacctgcaccctgccctccgacatcaacgtgcggtactacaacatctactggtatcagcagaagcccggcagcccccccagatacctgctgtactactactccgactcccacaagggccagggctccggcgtgccctccagattctccggctccaaggacgtgtccaccaactccggcatcctgctgatctccggcctgcagtccgaggacattgccacctactactgcatgacttggagcagcaacggcagcggcgtgttcggcggaggcacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 491 - DNA, 642 bp, Artificial Sequence
  Description of Artificial Sequence: Synthetic Polynucleotide sequence of Anti-CD138 kappa light chain
gacatccagatgacccagagcacatcctctctgagcgcctccctgggcgatcgcgtgactatcagttgcagcgcttcccaagggattaacaattacctcaactggtaccagcagaagcccgacggaaccgtcgagctgctcatctattacacatctacgctgcaaagcggcgtgccttccaggttctcagggagcggttccggaactgattactctctgaccattagcaatctcgaaccagaagacatcggcacatattactgtcagcagtactccaagctgccccggacttttgggggaggcaccaaactggagatcaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 492 - DNA, 1347 bp, Artificial Sequence
  Description of Artificial Sequence: Synthetic Polynucleotide sequence of Anti-CD138 IgG4 (S228P)
caggtgcagctccaacagagcggctccgaactgatgatgcctggggcctctgtcaagatttcctgcaaagctaccggctacacattcagcaactattggattgagtgggtgaagcagcgcccagggcacggtctggagtggatcggagagatcctgccaggcaccgggaggactatttacaatgaaaagtttaaaggaaaggccacattcaccgcagacatctctagcaacactgttcaaatgcagctctcctctctgacctccgaggatagcgccgtgtattactgtgctcggagagactactatggcaatttttactatgctatggattactggggacagggcacatctgtgaccgtcagctccgctagcaccaagggccccagcgtgttccccctggccccttgtagcagaagcaccagcgagagcacagccgccctgggctgcctggtgaaagactacttccccgagcccgtcaccgtgtcctggaacagcggagccctgaccagcggcgtgcacacctttccagccgtgctgcagagcagcggcctgtacagcctgagcagcgtggtgacagtgccctccagcagcctgggcaccaagacctacacctgtaacgtggaccacaagcccagcaacaccaaggtggacaagcgggtggaatctaagtacggcccaccctgccccccctgccctgcccctgaatttctgggcggaccctccgtgttcctgttccccccaaagcccaaggacaccctgatgatcagccggacccccgaagtgacctgcgtggtggtggacgtgtcccaggaagatcccgaggtccagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaagtctccaacaagggcctgcccagctccatcgagaaaaccatcagcaaggccaagggccagccccgcgagcctcaggtgtacacactgccccccagccaggaagagatgaccaagaaccaggtgtccctgacctgtctggtgaaaggcttctaccccagcgatatcgccgtggaatgggagagcaacggccagcccgagaacaactacaagaccaccccccctgtgctggacagcgacggcagcttcttcctgtactcccggctgaccgtggacaagagccggtggcaggaaggcaacgtcttcagctgcagcgtgatgcacgaggccctgcacaaccactacacccagaagtccctgagcctgagcctgggcaag

SEQ ID NO: 493 - DNA, 1341 bp, Artificial Sequence
  Description of Artificial Sequence: Synthetic Polynucleotide sequence of Anti-HLA IgG4 (S228P)
caggtccaactcaagcagtccggtccggggctggtccagccatctcaatcactgtctcttacttgcaccgtgtccggattcagcctgacctcatacggagtgcattgggtgcggcagcctcccgggaaaggactggagtggctcggagtcatttggtccggtggatcaactgactacaatgccgctttcatcagcaggctgagcattcggaaggacaactctaagagccaagtgttcttcaagatgaactcactccaggccgatgacaccgccatctactattgtgccagaaccttcaccaccagcacctctgcatggtttgcatactggggccagggcactcttgtgaccgtgtcagctgctagcaccaagggccccagcgtgttccccctggccccttgtagcagaagcaccagcgagagcacagccgccctgggctgcctggtgaaagactacttccccgagcccgtcaccgtgtcctggaacagcggagccctgaccagcggcgtgcacacctttccagccgtgctgcagagcagcggcctgtacagcctgagcagcgtggtgacagtgccctccagcagcctgggcaccaagacctacacctgtaacgtggaccacaagcccagcaacaccaaggtggacaagcgggtggaatctaagtacggcccaccctgccccccctgccctgcccctgaatttctgggcggaccctccgtgttcctgttccccccaaagcccaaggacaccctgatgatcagccggacccccgaagtgacctgcgtggtggtggacgtgtcccaggaagatcccgaggtccagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaagtctccaacaagggcctgcccagctccatcgagaaaaccatcagcaaggccaagggccagccccgcgagcctcaggtgtacacactgccccccagccaggaagagatgaccaagaaccaggtgtccctgacctgtctggtgaaaggcttctaccccagcgatatcgccgtggaatgggagagcaacggccagcccgagaacaactacaagaccaccccccctgtgctggacagcgacggcagcttcttcctgtactcccggctgaccgtggacaagagccggtggcaggaaggcaacgtcttcagctgcagcgtgatgcacgaggccctgcacaaccactacacccagaagtccctgagcctgagcctgggcaag

SEQ ID NO: 494 - DNA, 645 bp, Artificial Sequence
  Description of Artificial Sequence: Synthetic Polynucleotide sequence of Anti-HLA VK
tctatcgtcatgacccagaccccgaagttcctcctggtgtcagctggtgatcgggtgaccatcacttgtaaggcctctcagtctgtctcaaacgacgtcgcatggtaccaacaaaagcctgggcagtcacctaagcttctgatctactatgcttccaatcgctacaccggcgtgcccgacaggttcaccggatcagggtacggaaccgacttcacctttactatttccaccgtgcaggccgaggacctcgccgtgtatttctgccagcaagattacagcagcccaccctggactttcggtggaggaactaaactggaaattagacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 495 - DNA, 1350 bp, Artificial Sequence
  Description of Artificial Sequence: Synthetic Polynucleotide sequence of 10.21 formatted as an IgG1
gaagtgcagctggtgcagtctggcgccgaagtgaagaaacctggcgccaccgtgaagatcagctgcaaggtgtccggctacaccttcaccgacagcgtgatgaactgggtgcagcaggcccctggcaagggcctggaatggatgggatggatcgaccccgagtacggcagaaccgacgtggccgagaagttccagggcagagtgaccatcaccgccgacaccagcaccgacaccgcctacatggaactgagcagcctgcggagcgaggacaccgccgtgtactactgtgcccggaccaagtacaacagcggctacggcttcccctactggggccagggcacaaccgtgacagtgtcctcagctagcaccaagggacccagcgtgttccctctggcccctagcagcaagagcacatctggcggaacagccgccctgggctgcctcgtgaaggactactttcccgagcctgtcaccgtgtcttggaactctggcgccctgacaagcggcgtgcacacctttccagccgtgctgcagagcagcggcctgtactctctgagcagcgtcgtgacagtgcccagctctagcctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcccagagaggaacagtacaacagcacctaccgggtggtgtccgtgctgacagtgctgcaccaggactggctgaacggcaaagagtacaagtgcaaggtgtccaacaaggccctgcctgcccccatcgagaaaaccatcagcaaggccaagggccagccccgcgaaccccaggtgtacacactgcccccaagcagggacgagctgaccaagaaccaggtgtccctgacctgtctcgtgaaaggcttctacccctccgatatcgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgcagcgtgatgcacgaggccctgcacaaccactacacccagaagtccctgagcctgagccccggcaag

SEQ ID NO: 496 - DNA, 1338 bp, Artificial Sequence
  Description of Artificial Sequence: Synthetic Polynucleotide sequence of 10.21 IgG2
gaagtgcagctggtgcagtctggcgccgaagtgaagaaacctggcgccaccgtgaagatcagctgcaaggtgtccggctacaccttcaccgacagcgtgatgaactgggtgcagcaggcccctggcaagggcctggaatggatgggatggatcgaccccgagtacggcagaaccgacgtggccgagaagttccagggcagagtgaccatcaccgccgacaccagcaccgacaccgcctacatggaactgagcagcctgcggagcgaggacaccgccgtgtactactgtgcccggaccaagtacaacagcggctacggcttcccctactggggccagggcacaaccgtgacagtgtcctcagccagcaccaagggccccagcgtgttccccctggccccctgcagcagaagcaccagcgagagcacagccgccctgggctgcctggtgaaggactacttccccgagcccgtgacagtgagctggaacagcggagccctgacctccggtgtacacaccttccccgccgtgctgcagagcagcggcctgtactccctgagcagcgtggtgaccgtgcccagcagcaacttcggcacccagacctacacctgcaacgtggaccacaagcccagcaacaccaaggtggacaagaccgtggagaggaagtgctgcgtggagtgccccccctgcccagcccccccagtggccggaccctccgtgtttctgttcccccccaagcccaaggacaccctgatgatcagcaggacccccgaggtgacctgcgtggtggtggacgtgagccacgaggatccggaggtgcagttcaactggtacgtggacggcgtggaggtgcacaacgccaagaccaagcccagagaggagcagtttaacagcaccttcagggtggtgtccgtgctgaccgtggtgcaccaggactggctgaacggcaaggaatacaagtgcaaggtctccaacaagggcctgccagcccccatcgagaaaaccatcagcaagaccaagggccagccacgggagccccaagtgtataccctgccccccagccgggaggagatgaccaagaaccaggtgtccctgacctgtctggtgaagggcttctaccccagcgacatcgccgtggagtgggagagcaacggccagcccgagaacaactacaagaccaccccccccatgctggacagcgacggcagcttcttcctgtactccaagctgacagtggacaagtccaggtggcagcagggcaacgtgttcagctgcagcgtgatgcacgaggccctgcacaaccactacacccagaagagcctgagcctgtcccccggcaag

SEQ ID NO: 497 - DNA, 1491 bp, Artificial Sequence
  Description of Artificial Sequence: Synthetic Polynucleotide sequence of 10.21 IgG3
gaagtgcagctggtgcagtctggcgccgaagtgaagaaacctggcgccaccgtgaagatcagctgcaaggtgtccggctacaccttcaccgacagcgtgatgaactgggtgcagcaggcccctggcaagggcctggaatggatgggatggatcgaccccgagtacggcagaaccgacgtggccgagaagttccagggcagagtgaccatcaccgccgacaccagcaccgacaccgcctacatggaactgagcagcctgcggagcgaggacaccgccgtgtactactgtgcccggaccaagtacaacagcggctacggcttcccctactggggccagggcacaaccgtgacagtgtcctcagcgagcaccaaaggcccgagcgtgtttccgctggcgccgtgcagccgcagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatacctgcaacgtgaaccataaaccgagcaacaccaaagtggataaacgcgtggaactgaaaaccccgctgggcgataccacccatacctgcccgcgctgcccggaaccgaaaagctgcgataccccgccgccgtgcccgcgctgcccggaaccgaaaagctgcgataccccgccgccgtgcccgcgctgcccggaaccgaaaagctgcgataccccgccgccgtgcccgcgctgcccggcgccggaactgctgggcggcccgagcgtgtttctgtttccgccgaaaccgaaagataccctgatgattagccgcaccccggaagtgacctgcgtggtggtggatgtgagccatgaagatccggaagtgcagtttaaatggtatgtggatggcgtggaagtgcataacgcgaaaaccaaaccgcgcgaagaacagtttaacagcacctttcgcgtggtgagcgtgctgaccgtgctgcatcaggattggctgaacggcaaagaatataaatgcaaagtgagcaacaaagcgctgccggcgccgattgaaaaaaccattagcaaaaccaaaggccagccgcgcgaaccgcaggtgtataccctgccgccgagccgcgaagaaatgaccaaaaaccaggtgagcctgacctgcctggtgaaaggcttttatccgagcgatattgcggtggaatgggaaagcagcggccagccggaaaacaactataacaccaccccgccgatgctggatagcgatggcagcttttttctgtatagcaaactgaccgtggataaaagccgctggcagcagggcaacatttttagctgcagcgtgatgcatgaagcgctgcataaccgctttacccagaaaagcctgagcctgagcccgggcaaa

SEQ ID NO: 498 - protein, 165 aa, Artificial Sequence
  Description of Artificial Sequence: Synthetic Glycosylated (T106T) human interferon alpha-2-b comprising attenuating mutation A145X where X can be any amino acid selected from D, E, G, H, I, K, L, M, N, Q, R, S, T, V, Y
  MOD_RES (145)..(145): D, E, G, H, I, K, L, M, N, Q, R, S, T, V, or Y
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRXEIMRSFSLSTNLQESLRSKE

SEQ ID NO: 499 - protein, 165 aa, Artificial Sequence
  Description of Artificial Sequence: Synthetic Glycosylated (T106T) human interferon alpha-2-b comprising attenuating mutation R144X where X can be any amino acid selected from A, D, E, G, H, I, K, L, N, Q, S, T, V, Y
  MOD_RES (144)..(144): A, D, E, G, H, I, K, L, N, Q, S, T, V, or Y
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVXAEIMRSFSLSTNLQESLRSKE

SEQ ID NO: 500 - protein, 165 aa, Artificial Sequence
  Description of Artificial Sequence: Synthetic Glycosylated (T106T) human interferon alpha-2-b comprising attenuating mutation R33X, where X can be any amino acid selected from K, A, Q
  MOD_RES (33)..(33): K, A, or Q
CDLPQTHSLGSRRTLMLLAQMRRISLFSCLKDXHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 501 - protein, 164 aa, Artificial Sequence
  Description of Artificial Sequence: Synthetic interferon alpha-2-b comprising with deletion of amino acid at position 106 and comprising attenuating mutation A144X
  CONT. FROM ABOVE: where X, can be any amino acid selected from D, E, G, H, I, K, L, M, N, Q, R, S, T, V, Y
  MOD_RES (144)..(144): D, E, G, H, I, K, L, M, N, Q, R, S, T, V, or Y
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVETPLMKEDSILAVRKYFQRITLYLKEKKYSPCAWEVVRXEIMRSFSLSTNLQESLRSKE

SEQ ID NO: 502 - protein, 450 aa, Artificial Sequence
  Description of Artificial Sequence: Synthetic VH sequence of 10.21 formatted as an IgG1 incorporating substitutions M255Y, S257T, T259E
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - protein, 446 aa, Artificial Sequence
  Description of Artificial Sequence: Synthetic VH sequence of 10.21 formatted onto an IgG2 backbone incorporating substitutions A330S and P331S
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 504 - protein, 120 aa, Artificial Sequence
  Description of Artificial Sequence: Synthetic Anti CD38 VH
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSS

SEQ ID NO: 505 - protein, 107 aa, Artificial Sequence
  Description of Artificial Sequence: Synthetic Anti CD38 VL
DIQMTQSPSSLSASVGDRVTITCKASQNVDSDVDWYQQKPGKAPKLLIYKASNRYTGVPSRFSGSGSGTDFTFTISSLQPEDIATYYCMQSNTHPRTFGGGTKVEIK

SEQ ID NO: 506 - protein, 447 aa, Artificial Sequence; identical to SEQ ID NO: 442
  Description of Artificial Sequence: Synthetic Anti CD38 heavy chain

SEQ ID NO: 507 - protein, 214 aa, Artificial Sequence
  Description of Artificial Sequence: Synthetic polypeptide
DIQMTQSPSSLSASVGDRVTITCKASQNVDSDVDWYQQKPGKAPKLLIYKASNRYTGVPSRFSGSGSGTDFTFTISSLQPEDIATYYCMQSNTHPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 508 - protein, 612 aa, Artificial Sequence
  Description of Artificial Sequence: Synthetic polypeptide
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 509 - protein, 214 aa, Artificial Sequence
  Description of Artificial Sequence: Synthetic Anti CD47 light chain
DIVMTQSPATLSVTPGDRVSLSCRASQTISDYLHWYQQKSHESPRLLIKFASQSISGIPSRFSGSGSGSDFTLSINSVEPEDVGVYYCQNGHGFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 510 - protein, 445 aa, Artificial Sequence
  Description of Artificial Sequence: Synthetic Anti CD47 heavy chain
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 511 - protein, 120 aa, Artificial Sequence
  Description of Artificial Sequence: Synthetic Completely synthesized sequence
  MOD_RES (1)..(1): E or Q
  MOD_RES (17)..(17): T or S
  MOD_RES (20)..(20): I or V
  MOD_RES (29)..(29): F or L
  MOD_RES (38)..(38): Q or R
  MOD_RES (40)..(40): E, G, H, or A
  MOD_RES (62)..(62): E or Q
  MOD_RES (70)..(70): I or M
  MOD_RES (100)..(100): K, G, or T
  MOD_RES (102)..(102): N or Q
XVQLVQSGAEVKKPGAXVKXSCKVSGYTXTDSVMNWVXQXPGKGLEWMGWIDPEYGRTDVAXKFQGRVTXTADTSTDTAYMELSSLRSEDTAVYYCARTXYXSGYGFPYWGQGTTVTVSS

SEQ ID NO: 512 - protein, 108 aa, Artificial Sequence
  Description of Artificial Sequence: Synthetic Completely synthesized sequence
  MOD_RES (24)..(24): K, G, or Q
  MOD_RES (53)..(53): N or Q
  MOD_RES (54)..(54): R or D
  MOD_RES (89)..(89): M or A
DIQMTQSPSSLSASVGDRVTITCXASQNVDSDVDWYQQKPGKAPKLLIYKASXXYTGVPSRFSGSGSGTDFTFTISSLQPEDIATYYCXQSNTHPRTFGGGTKVEIKR

SEQ ID NO: 513 - protein, 214 aa, Mus musculus
DIVMTQSPATLSVTPGDRVSLSCRASQTISDYLHWYQQKSHESPRLLIKFASQSISGIPSRFSGSGSGSDFTLSINSVEPEDVGVYYCQNGHGFPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 514 - protein, 442 aa, Mus musculus
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 515 - protein, 214 aa, Mus musculus; identical to SEQ ID NO: 513

SEQ ID NO: 516 - protein, 442 aa, Mus musculus
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFASTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 517 - protein, 214 aa, Mus musculus
DIKMTQSPSSLYASLGERVTITCKASQDIHRYLSWFQQKPGKSPKILIYRANRLVDGVPSRFSGSGSGQDYSLTISSLEYEDMGIYYCLQYDEFPYTFGGGTKLEMKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 518 - protein, 444 aa, Mus musculus
EVQLQQSGAELVRSGASVKLSCTASGFNIKDYYLHWVKQRPEQGLEWIGWIDPDNGDTEFAPKFQGKATMTADTSSNTAYLQLSSLTSEDTAVYYCNAAYGSSSYPMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFASTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 519 - protein, 219 aa, Mus musculus
DVLMTQTPLSLPVSLGDQASISCRSSQSIVYSNGNTYLGWYLQKPGQSPKLLIYKVSNRFSGVPDRFSGSGSGTDFTLKISRVEAEDLGVYHCFQGSHVPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 520 - protein, 441 aa, Mus musculus
QVQLQQPGAELVKPGASVMMSCKASGYTFTNYNMHWVKQTPGQGLEWIGTIYPGNDDTSYNQKFKDKATLTADKSSSAAYMQLSSLTSEDSAVYYCARGGYRAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFASTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 521 - protein, 215 aa, Homo sapiens; identical to SEQ ID NO: 281

SEQ ID NO: 522 - protein, 612 aa, Homo sapiens; identical to SEQ ID NO: 285

SEQ ID NO: 523 - protein, 214 aa, Homo sapiens
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - protein, 613 aa, Homo sapiens
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 525 - protein, 214 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 614 aa, Homo sapiens
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 527 - protein, 218 aa, Homo sapiens
EIVLTQSPDFQSVTPKEKVTITCRASESVDTFGISFMNWFQQKPDQSPKLLIHEASNQGSGVPSRFSGSGSGTDFTLTINSLEAEDAATYYCQQSKEVPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 528 - protein, 613 aa, Homo sapiens
EVQLVESGGGLVQPGGSLRLSCAASGFTFSSSWMNWVRQAPGKGLEWVGRIYPGDGDTNYNVKFKGRFTISRDDSKNSLYLQMNSLKTEDTAVYYCARSGFITTVRDFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 529 - protein, 214 aa, Homo sapiens
DIQLTQSPSSLSASLGERVSLTCRASQEISVSLSWLQQKPDGTIKRLIYATSTLDSGVPKRFSGSRSGSDYSLTISSLESEDFADYYCLQYASYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 530 - protein, 605 aa, Homo sapiens
EVQLVESGPELKKPGETVKISCKASGYTFTDYSMHWVKQAPGKGLKWMGWINTETGEPTFADDFKGRFAFSLETSARTTYLQINNLKNEDTATYFCARTAVYWGQGTSLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 531 - protein, 612 aa, Artificial Sequence
  Description of Artificial Sequence: Synthetic Anti CD38 attenkine Heavy Chain N297A
EVQLVQSGAEVKKPGATVKISCKVSGYTFTDSVMNWVQQAPGKGLEWMGWIDPEYGRTDVAEKFQGRVTITADTSTDTAYMELSSLRSEDTAVYYCARTKYNSGYGFPYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 532 - protein, 612 aa, Homo sapiens; identical to SEQ ID NO: 479

SEQ ID NO: 533 - protein, 214 aa, Homo sapiens; identical to SEQ ID NO: 473

SEQ ID NO: 534 - protein, 445 aa, Artificial Sequence
  Description of Artificial Sequence: Synthetic Anti CD47 heavy chain aglcosylated
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 535 - protein, 107 aa, Homo sapiens
DIQMTQSPSSLSASVGDRVTITCKASQNVDSDVDWYQQKPGKAPKLLIYKASNDYTGVPSRFSGSGSGTDFTFTISSLQPEDIATYYCMQSNTHPRTFGGGTKVEIK

SEQ ID NO: 536 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVAETPLMKEDSILAVRKYFQRITLYLKEKKYSPCAWEVVRDEIMRSFSLSTNLQESLRSKE

SEQ ID NO: 537 - protein, 448 aa, Homo sapiens
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 538 - protein, 107 aa, Homo sapiens; identical to SEQ ID NO: 535

SEQ ID NO: 539 - protein, 15 aa, Artificial Sequence
  Description of Artificial Sequence: Synthetic peptide
  MISC_FEATURE (1)..(15): This sequence may encompass 1-3 "Gly Gly Gly Gly Ser" repeating units
GGGGSGGGGSGGGGS

The invention claimed is:

1. A method of treating a tumour in a subject comprising: administering a combination therapy, the combination therapy comprising (i) a polypeptide construct comprising an attenuated Type I interferon α2b (IFNα2b) linked to an antibody which binds to a cell surface-associated antigen expressed on the tumour cell and which comprises a functional Fc region and (ii) a CD47 antagonist which inhibits the interaction of CD47 with the SIRPα receptor, wherein the CD47 antagonist is: an anti-CD47 antibody; an anti-SIRPα antibody; or the extracellular domain of SIRPα.

2. The method of claim 1, wherein the attenuated Type I IFNα2b is linked to the antibody via a peptide bond.

3. The method of claim 1, wherein the attenuated Type I IFNα2b is linked to the antibody directly or via a linker of 1 to 20 amino acids in length.

4. The method of claim 1, wherein the attenuated Type I IFNα2b is linked to the C-terminus of the light chain or heavy chain constant region of the antibody.

5. The method of claim 1, wherein the attenuated IFNα2b has a sequence which comprises, relative to SEQ ID NO: 3, at least one amino acid substitution or deletion selected from the group consisting of L15A, R22A, R23A, S25A, L26A, F27A, L30A, L30V, K31A, D32A, R33A, R33K, R33Q, H34A, Q40A, D114R, L117A, R120A, R120E, R125A, R125E, K131A, E132A, K133A, K134A, M148A, R149A, S152A, L153A, N156A, (L30A, H57Y, E58N and Q61S), (R33A, H57Y, E58N and Q61S), (M148A, H57Y, E58N and Q61S), (L153A, H57Y, E58N and Q61S), (R144A, H57Y, E58N and Q61S), (N65A, L80A, Y85A and Y89A), (N65A, L80A, Y85A, Y89A and D114A), (N65A, L80A, Y85A, Y89A and L117A), (N65A, L80A, Y85A, Y89A and R120A), (Y85A, Y89A and D114A), (D114A and R120A), (L117A and R120A), (L117A, R120A and K121A), (R120A and K121A), (R120E and K121E), replacement of R at position 144 with A, D, E, G, H, I, K, L, N, Q, S, T, V or Y, replacement of A at position 145 with D, E, G, H, I, K, L, M, N, Q, S, T, V or Y, deletion of residues L161 to E165, and combinations thereof.

6. The method of claim 1, wherein the attenuated IFNα2b is an aglycosylated attenuated IFNα2b, wherein T106 of the aglycosylated attenuated IFNα2b is deleted or substituted with an amino acid other than T.

7. The method of claim 6, wherein T106 of the aglycosylated attenuated IFNα2b is substituted with A.

8. The method of claim 6, wherein T106 of the aglycosylated attenuated IFNα2b is deleted.

9. The method of claim 1, wherein the sequence of the attenuated IFNα2b is SEQ ID NO: 44 or SEQ ID NO: 536.

10. The method of claim 1, wherein the cell surface-associated antigen is selected from the group consisting of CD38, CD138, RANK-Ligand, HM1.24, CD56, CS1, CD20, CD74, IL-6R, EpCAM, Blys (BAFF), BCMA, Kininogen, beta2 microglobulin, FGFR3, ICAM-1, matriptase, CD52, EGFR, GM2, alpha4-integrin, IFG-1R, KIR, CD3, CD4, CD8, CD24, CD30, CD37, CD44, CD69, CD71, CD79, CD83, CD86, CD96, HLA, PD-1, ICOS, CD33, CD115, CD11c, CD19, CD52, CD14, FSP1, FAP, PDGFR alpha, PDGFR beta, ASGR1, ASGR2, FSP1, LyPD3, RTI140/Ti-alpha, HTI56, VEGF receptor, CD241 the product of the RCHE gene, CD117 (c-kit), CD71 (transferrin receptor), CD36 (thrombospondin receptor), CD34, CD45RO, CD45RA, CD115, CD168, CD235, CD236, CD237, CD238, CD239, CD240, TROP2, CD70, CCR2, HER2, EGFR and CCR3.

11. The method of claim 10, wherein the cell surface-associated antigen is CD38.

12. The method of claim 10, wherein the cell surface-associated antigen is selected from the group consisting of CD38, CD138, EpCAM, TROP2, CD19, CD20, CD79b, CD22 and CD52.

13. The method of claim 12, wherein the $V_H$ sequence of the antibody is selected from the group consisting of SEQ ID NOs: 342, 344, 346, 504 and 511.

14. The method of claim 12, wherein the $V_L$ sequence of the antibody is selected from the group consisting of SEQ ID NOs: 341, 343, 345, 505, 512, 535 and 538.

15. The method of claim 1, wherein the sequence of the polypeptide construct comprises SEQ ID NO: 508 and SEQ ID NO: 507 or SEQ ID NO: 532 and SEQ ID NO: 533.

16. The method of claim 1, wherein the anti-CD47 antibody is a human antibody or a humanized monoclonal antibody.

17. The method of claim 1, wherein the anti-CD47 antibody is aglycosylated.

18. The method of claim 1, wherein the sequence of the light chain comprises SEQ ID NO: 509 and the sequence of the heavy chain comprises SEQ ID NO: 510 or SEQ ID NO: 534.

19. The method of claim 1, wherein the anti-SIRPα antibody is a human antibody or a humanized monoclonal antibody.

20. The method of claim 1, wherein the extracellular domain of SIRPα is attached to an Fc.

21. The method of claim 1, wherein the tumour is selected from multiple myeloma or non-Hodgkin's lymphoma.

* * * * *